United States Patent 12,544,458 (PAH-MODULATING COMPOSITIONS AND METHODS) - sequence listing, part 7

SEQ ID NO: 25827 - DNA, 17 bp, synthetic construct
  source 1..17: mol_type = other DNA
caagctgggatgaaaag

SEQ ID NO: 25828 - DNA, 17 bp, synthetic construct
  source 1..17: mol_type = other DNA
caagctgggatgaaaag

SEQ ID NO: 25829 - DNA, 17 bp, synthetic construct
  source 1..17: mol_type = other DNA
tttcctctcgggatttc

SEQ ID NO: 25830 - DNA, 17 bp, synthetic construct
  source 1..17: mol_type = other DNA
caagctgggatgaaaag

SEQ ID NO: 25831 - DNA, 17 bp, synthetic construct
  source 1..17: mol_type = other DNA
tttcctctcgggatttc

SEQ ID NO: 25832 - DNA, 17 bp, synthetic construct
  source 1..17: mol_type = other DNA
aagctgggatgaaaaga

SEQ ID NO: 25833 - DNA, 17 bp, synthetic construct
  source 1..17: mol_type = other DNA
aagctgggatgaaaaga

SEQ ID NO: 25834 - DNA, 17 bp, synthetic construct
  source 1..17: mol_type = other DNA
ttcctctcgggatttct

SEQ ID NO: 25835 - DNA, 17 bp, synthetic construct
  source 1..17: mol_type = other DNA
ttcctctcgggatttct

SEQ ID NO: 25836 - DNA, 17 bp, synthetic construct
  source 1..17: mol_type = other DNA
ttcctctcgggatttct

SEQ ID NO: 25837 - DNA, 17 bp, synthetic construct
  source 1..17: mol_type = other DNA
aagctgggatgaaaaga

SEQ ID NO: 25838 - DNA, 17 bp, synthetic construct
  source 1..17: mol_type = other DNA
aagctgggatgaaaaga

SEQ ID NO: 25839 - DNA, 17 bp, synthetic construct
  source 1..17: mol_type = other DNA
ttcctctcgggatttct

SEQ ID NO: 25840 - DNA, 17 bp, synthetic construct
  source 1..17: mol_type = other DNA
ttcctctcgggatttct

SEQ ID NO: 25841 - DNA, 17 bp, synthetic construct
  source 1..17: mol_type = other DNA
tcctctcgggatttctt

SEQ ID NO: 25842 - DNA, 17 bp, synthetic construct
  source 1..17: mol_type = other DNA
agctgggatgaaaagaa

SEQ ID NO: 25843 - DNA, 17 bp, synthetic construct
  source 1..17: mol_type = other DNA
agctgggatgaaaagaa

SEQ ID NO: 25844 - DNA, 17 bp, synthetic construct
  source 1..17: mol_type = other DNA
agctgggatgaaaagaa

SEQ ID NO: 25845 - DNA, 17 bp, synthetic construct
  source 1..17: mol_type = other DNA
tcctctcgggatttctt

SEQ ID NO: 25846 - DNA, 17 bp, synthetic construct
  source 1..17: mol_type = other DNA
tcctctcgggatttctt

SEQ ID NO: 25847 - DNA, 17 bp, synthetic construct
  source 1..17: mol_type = other DNA
tcctctcgggatttctt

SEQ ID NO: 25848 - DNA, 17 bp, synthetic construct
  source 1..17: mol_type = other DNA
tcctctcgggatttctt

SEQ ID NO: 25849 - DNA, 17 bp, synthetic construct
  source 1..17: mol_type = other DNA
agctgggatgaaaagaa

SEQ ID NO: 25850 - DNA, 17 bp, synthetic construct
  source 1..17: mol_type = other DNA
tcctctcgggatttctt

SEQ ID NO: 25851 - DNA, 17 bp, synthetic construct
  source 1..17: mol_type = other DNA
tcctctcgggatttctt

SEQ ID NO: 25852 - DNA, 17 bp, synthetic construct
  source 1..17: mol_type = other DNA
cctctcgggatttcttg

SEQ ID NO: 25853 - DNA, 17 bp, synthetic construct
  source 1..17: mol_type = other DNA
cctctcgggatttcttg

SEQ ID NO: 25854 - DNA, 17 bp, synthetic construct
  source 1..17: mol_type = other DNA
gctgggatgaaaagaag

SEQ ID NO: 25855 - DNA, 17 bp, synthetic construct
  source 1..17: mol_type = other DNA
cctctcgggatttcttg

SEQ ID NO: 25856 - DNA, 17 bp, synthetic construct
  source 1..17: mol_type = other DNA
ctctcgggatttcttgg

SEQ ID NO: 25857 - DNA, 17 bp, synthetic construct
  source 1..17: mol_type = other DNA
ctctcgggatttcttgg

SEQ ID NO: 25858 - DNA, 17 bp, synthetic construct
  source 1..17: mol_type = other DNA
ctctcgggatttcttgg

SEQ ID NO: 25859 - DNA, 17 bp, synthetic construct
  source 1..17: mol_type = other DNA
ctgggatgaaaagaaga

SEQ ID NO: 25860 - DNA, 17 bp, synthetic construct
  source 1..17: mol_type = other DNA
tctcgggatttcttggg

SEQ ID NO: 25861 - DNA, 17 bp, synthetic construct
  source 1..17: mol_type = other DNA
tctcgggatttcttggg

SEQ ID NO: 25862 - DNA, 17 bp, synthetic construct
  source 1..17: mol_type = other DNA
tgggatgaaaagaagaa

SEQ ID NO: 25863 - DNA, 17 bp, synthetic construct
  source 1..17: mol_type = other DNA
tgggatgaaaagaagaa

SEQ ID NO: 25864 - DNA, 17 bp, synthetic construct
  source 1..17: mol_type = other DNA
tgggatgaaaagaagaa

SEQ ID NO: 25865 - DNA, 17 bp, synthetic construct
  source 1..17: mol_type = other DNA
tgggatgaaaagaagaa

SEQ ID NO: 25866 - DNA, 17 bp, synthetic construct
  source 1..17: mol_type = other DNA
ctcgggatttcttgggt

SEQ ID NO: 25867 - DNA, 17 bp, synthetic construct
  source 1..17: mol_type = other DNA
gggatgaaaagaagaaa

SEQ ID NO: 25868 - DNA, 17 bp, synthetic construct
  source 1..17: mol_type = other DNA
gggatgaaaagaagaaa

SEQ ID NO: 25869 - DNA, 17 bp, synthetic construct
  source 1..17: mol_type = other DNA
ctcgggatttcttgggt

SEQ ID NO: 25870 - DNA, 17 bp, synthetic construct
  source 1..17: mol_type = other DNA
ctcgggatttcttgggt

SEQ ID NO: 25871 - DNA, 17 bp, synthetic construct
  source 1..17: mol_type = other DNA
ctcgggatttcttgggt

SEQ ID NO: 25872 - DNA, 17 bp, synthetic construct
  source 1..17: mol_type = other DNA
tcgggatttcttgggtg

SEQ ID NO: 25873 - DNA, 17 bp, synthetic construct
  source 1..17: mol_type = other DNA
tcgggatttcttgggtg

SEQ ID NO: 25874 - DNA, 17 bp, synthetic construct
  source 1..17: mol_type = other DNA
ggatgaaaagaagaaag

SEQ ID NO: 25875 - DNA, 17 bp, synthetic construct
  source 1..17: mol_type = other DNA
ggatgaaaagaagaaag

SEQ ID NO: 25876 - DNA, 17 bp, synthetic construct
  source 1..17: mol_type = other DNA
cgggatttcttgggtgg

SEQ ID NO: 25877 - DNA, 17 bp, synthetic construct
  source 1..17: mol_type = other DNA
cgggatttcttgggtgg

SEQ ID NO: 25878 - DNA, 17 bp, synthetic construct
  source 1..17: mol_type = other DNA
cgggatttcttgggtgg

SEQ ID NO: 25879 - DNA, 17 bp, synthetic construct
  source 1..17: mol_type = other DNA
gatgaaaagaagaaaga

SEQ ID NO: 25880 - DNA, 17 bp, synthetic construct
  source 1..17: mol_type = other DNA
gggatttcttgggtggc

SEQ ID NO: 25881 - DNA, 17 bp, synthetic construct
  source 1..17: mol_type = other DNA
gggatttcttgggtggc

SEQ ID NO: 25882 - DNA, 17 bp, synthetic construct
  source 1..17: mol_type = other DNA
gggatttcttgggtggc

SEQ ID NO: 25883 - DNA, 17 bp, synthetic construct
  source 1..17: mol_type = other DNA
gggatttcttgggtggc

SEQ ID NO: 25884 - DNA, 17 bp, synthetic construct
  source 1..17: mol_type = other DNA
gggatttcttgggtggc

SEQ ID NO: 25885 - DNA, 17 bp, synthetic construct
  source 1..17: mol_type = other DNA
gggatttcttgggtggc

SEQ ID NO: 25886 - DNA, 17 bp, synthetic construct
  source 1..17: mol_type = other DNA
atgaaaagaagaaagaa

SEQ ID NO: 25887 - DNA, 17 bp, synthetic construct
  source 1..17: mol_type = other DNA
atgaaaagaagaaagaa

SEQ ID NO: 25888 - DNA, 17 bp, synthetic construct
  source 1..17: mol_type = other DNA
ggatttcttgggtggcc

SEQ ID NO: 25889 - DNA, 17 bp, synthetic construct
  source 1..17: mol_type = other DNA
ggatttcttgggtggcc

SEQ ID NO: 25890 - DNA, 17 bp, synthetic construct
  source 1..17: mol_type = other DNA
ggatttcttgggtggcc

SEQ ID NO: 25891 - DNA, 17 bp, synthetic construct
  source 1..17: mol_type = other DNA
ggatttcttgggtggcc

SEQ ID NO: 25892 - DNA, 17 bp, synthetic construct
  source 1..17: mol_type = other DNA
ggatttcttgggtggcc

SEQ ID NO: 25893 - DNA, 17 bp, synthetic construct
  source 1..17: mol_type = other DNA
ggatttcttgggtggcc

SEQ ID NO: 25894 - DNA, 17 bp, synthetic construct
  source 1..17: mol_type = other DNA
tgaaaagaagaaagaaa

SEQ ID NO: 25895 - DNA, 17 bp, synthetic construct
  source 1..17: mol_type = other DNA
tgaaaagaagaaagaaa

SEQ ID NO: 25896 - DNA, 17 bp, synthetic construct
  source 1..17: mol_type = other DNA
ggatttcttgggtggcc

SEQ ID NO: 25897 - DNA, 17 bp, synthetic construct
  source 1..17: mol_type = other DNA
gatttcttgggtggcct

SEQ ID NO: 25898 - DNA, 17 bp, synthetic construct
  source 1..17: mol_type = other DNA
gatttcttgggtggcct

SEQ ID NO: 25899 - DNA, 17 bp, synthetic construct
  source 1..17: mol_type = other DNA
gaaaagaagaaagaaaa

SEQ ID NO: 25900 - DNA, 17 bp, synthetic construct
  source 1..17: mol_type = other DNA
gatttcttgggtggcct

SEQ ID NO: 25901 - DNA, 17 bp, synthetic construct
  source 1..17: mol_type = other DNA
gatttcttgggtggcct

SEQ ID NO: 25902 - DNA, 17 bp, synthetic construct
  source 1..17: mol_type = other DNA
gaaaagaagaaagaaaa

SEQ ID NO: 25903 - DNA, 17 bp, synthetic construct
  source 1..17: mol_type = other DNA
gatttcttgggtggcct

SEQ ID NO: 25904 - DNA, 17 bp, synthetic construct
  source 1..17: mol_type = other DNA
gaaaagaagaaagaaaa

SEQ ID NO: 25905 - DNA, 17 bp, synthetic construct
  source 1..17: mol_type = other DNA
gaaaagaagaaagaaaa

SEQ ID NO: 25906 - DNA, 17 bp, synthetic construct
  source 1..17: mol_type = other DNA
atttcttgggtggcctg

SEQ ID NO: 25907 - DNA, 17 bp, synthetic construct
  source 1..17: mol_type = other DNA
atttcttgggtggcctg

SEQ ID NO: 25908 - DNA, 17 bp, synthetic construct
  source 1..17: mol_type = other DNA
aaaagaagaaagaaaac

SEQ ID NO: 25909 - DNA, 17 bp, synthetic construct
  source 1..17: mol_type = other DNA
atttcttgggtggcctg

SEQ ID NO: 25910 - DNA, 17 bp, synthetic construct
  source 1..17: mol_type = other DNA
atttcttgggtggcctg

SEQ ID NO: 25911 - DNA, 17 bp, synthetic construct
  source 1..17: mol_type = other DNA
aaaagaagaaagaaaac

SEQ ID NO: 25912 - DNA, 17 bp, synthetic construct
  source 1..17: mol_type = other DNA
tttcttgggtggcctgg

SEQ ID NO: 25913 - DNA, 17 bp, synthetic construct
  source 1..17: mol_type = other DNA
tttcttgggtggcctgg

SEQ ID NO: 25914 - DNA, 17 bp, synthetic construct
  source 1..17: mol_type = other DNA
tttcttgggtggcctgg

SEQ ID NO: 25915 - DNA, 17 bp, synthetic construct
  source 1..17: mol_type = other DNA
tttcttgggtggcctgg

SEQ ID NO: 25916 - DNA, 17 bp, synthetic construct
  source 1..17: mol_type = other DNA
aaagaagaaagaaaact

SEQ ID NO: 25917 - DNA, 51 bp, synthetic construct
  source 1..51: mol_type = other DNA
gctccagggggagaagctttggcttctctgataagcagtactgtaggcccc

SEQ ID NO: 25918 - DNA, 52 bp, synthetic construct
  source 1..52: mol_type = other DNA
gcagcagggaatactgatcctgatttaacagtgataataacttttcacttgg

SEQ ID NO: 25919 - DNA, 52 bp, synthetic construct
  source 1..52: mol_type = other DNA
gctccagggggagaagctttggcttctctgataagcagtactgtaggcccca

SEQ ID NO: 25920 - DNA, 52 bp, synthetic construct; identical to SEQ ID NO: 25918
  source 1..52: mol_type = other DNA

SEQ ID NO: 25921 - DNA, 52 bp, synthetic construct; identical to SEQ ID NO: 25919
  source 1..52: mol_type = other DNA

SEQ ID NO: 25922 - DNA, 52 bp, synthetic construct; identical to SEQ ID NO: 25918
  source 1..52: mol_type = other DNA

SEQ ID NO: 25923 - DNA, 53 bp, synthetic construct
  source 1..53: mol_type = other DNA
gctccagggggagaagctttggcttctctgataagcagtactgtaggccccaa

SEQ ID NO: 25924 - DNA, 53 bp, synthetic construct; identical to SEQ ID NO: 25923
  source 1..53: mol_type = other DNA

SEQ ID NO: 25925 - DNA, 53 bp, synthetic construct; identical to SEQ ID NO: 25923
  source 1..53: mol_type = other DNA

SEQ ID NO: 25926 - DNA, 53 bp, synthetic construct
  source 1..53: mol_type = other DNA
gcagcagggaatactgatcctgatttaacagtgataataacttttcacttggg

SEQ ID NO: 25927 - DNA, 53 bp, synthetic construct; identical to SEQ ID NO: 25926
  source 1..53: mol_type = other DNA

SEQ ID NO: 25928 - DNA, 53 bp, synthetic construct; identical to SEQ ID NO: 25923
  source 1..53: mol_type = other DNA

SEQ ID NO: 25929 - DNA, 53 bp, synthetic construct; identical to SEQ ID NO: 25923
  source 1..53: mol_type = other DNA

SEQ ID NO: 25930 - DNA, 54 bp, synthetic construct
  source 1..54: mol_type = other DNA
gctccagggggagaagctttggcttctctgataagcagtactgtaggccccaag

SEQ ID NO: 25931 - DNA, 54 bp, synthetic construct; identical to SEQ ID NO: 25930
  source 1..54: mol_type = other DNA

SEQ ID NO: 25932 - DNA, 54 bp, synthetic construct; identical to SEQ ID NO: 25930
  source 1..54: mol_type = other DNA

SEQ ID NO: 25933 - DNA, 54 bp, synthetic construct
  source 1..54: mol_type = other DNA
gcagcagggaatactgatcctgatttaacagtgataataacttttcacttgggg

SEQ ID NO: 25934 - DNA, 54 bp, synthetic construct; identical to SEQ ID NO: 25930
  source 1..54: mol_type = other DNA

SEQ ID NO: 25935 - DNA, 54 bp, synthetic construct; identical to SEQ ID NO: 25930
  source 1..54: mol_type = other DNA

SEQ ID NO: 25936 - DNA, 54 bp, synthetic construct; identical to SEQ ID NO: 25930
  source 1..54: mol_type = other DNA

SEQ ID NO: 25937 - DNA, 54 bp, synthetic construct; identical to SEQ ID NO: 25930
  source 1..54: mol_type = other DNA

SEQ ID NO: 25938 - DNA, 54 bp, synthetic construct; identical to SEQ ID NO: 25933
  source 1..54: mol_type = other DNA

SEQ ID NO: 25939 - DNA, 54 bp, synthetic construct; identical to SEQ ID NO: 25930
  source 1..54: mol_type = other DNA

SEQ ID NO: 25940 - DNA, 54 bp, synthetic construct; identical to SEQ ID NO: 25930
  source 1..54: mol_type = other DNA

SEQ ID NO: 25941 - DNA, 55 bp, synthetic construct
  source 1..55: mol_type = other DNA
gctccagggggagaagctttggcttctctgataagcagtactgtaggccccaagt

SEQ ID NO: 25942 - DNA, 55 bp, synthetic construct; identical to SEQ ID NO: 25941
  source 1..55: mol_type = other DNA

SEQ ID NO: 25943 - DNA, 55 bp, synthetic construct
  source 1..55: mol_type = other DNA
gcagcagggaatactgatcctgatttaacagtgataataacttttcacttggggc

SEQ ID NO: 25944 - DNA, 55 bp, synthetic construct; identical to SEQ ID NO: 25943
  source 1..55: mol_type = other DNA

SEQ ID NO: 25945 - DNA, 55 bp, synthetic construct; identical to SEQ ID NO: 25941
  source 1..55: mol_type = other DNA

SEQ ID NO: 25946 - DNA, 55 bp, synthetic construct; identical to SEQ ID NO: 25941
  source 1..55: mol_type = other DNA

SEQ ID NO: 25947 - DNA, 55 bp, synthetic construct; identical to SEQ ID NO: 25941
  source 1..55: mol_type = other DNA

SEQ ID NO: 25948 - DNA, 55 bp, synthetic construct; identical to SEQ ID NO: 25941
  source 1..55: mol_type = other DNA

SEQ ID NO: 25949 - DNA, 55 bp, synthetic construct; identical to SEQ ID NO: 25943
  source 1..55: mol_type = other DNA

SEQ ID NO: 25950 - DNA, 56 bp, synthetic construct
  source 1..56: mol_type = other DNA
gcagcagggaatactgatcctgatttaacagtgataataacttttcacttggggcc

SEQ ID NO: 25951 - DNA, 56 bp, synthetic construct
  source 1..56: mol_type = other DNA
gctccagggggagaagctttggcttctctgataagcagtactgtaggccccaagtg

SEQ ID NO: 25952 - DNA, 56 bp, synthetic construct; identical to SEQ ID NO: 25951
  source 1..56: mol_type = other DNA

SEQ ID NO: 25953 - DNA, 56 bp, synthetic construct; identical to SEQ ID NO: 25950
  source 1..56: mol_type = other DNA

SEQ ID NO: 25954 - DNA, 56 bp, synthetic construct; identical to SEQ ID NO: 25951
  source 1..56: mol_type = other DNA

SEQ ID NO: 25955 - DNA, 57 bp, synthetic construct
  source 1..57: mol_type = other DNA
gctccagggggagaagctttggcttctctgataagcagtactgtaggccccaagtga

SEQ ID NO: 25956 - DNA, 57 bp, synthetic construct
  source 1..57: mol_type = other DNA
gcagcagggaatactgatcctgatttaacagtgataataacttttcacttggggcct

SEQ ID NO: 25957 - DNA, 57 bp, synthetic construct; identical to SEQ ID NO: 25955
  source 1..57: mol_type = other DNA

SEQ ID NO: 25958 - DNA, 58 bp, synthetic construct
  source 1..58: mol_type = other DNA
gcagcagggaatactgatcctgatttaacagtgataataacttttcacttggggccta

SEQ ID NO: 25959 - DNA, 58 bp, synthetic construct
  source 1..58: mol_type = other DNA
gctccagggggagaagctttggcttctctgataagcagtactgtaggccccaagtgaa

SEQ ID NO: 25960 - DNA, 59 bp, synthetic construct
  source 1..59: mol_type = other DNA
gcagcagggaatactgatcctgatttaacagtgataataacttttcacttggggcctac

SEQ ID NO: 25961 - DNA, 59 bp, synthetic construct; identical to SEQ ID NO: 25960
  source 1..59: mol_type = other DNA

SEQ ID NO: 25962 - DNA, 59 bp, synthetic construct
  source 1..59: mol_type = other DNA
gctccagggggagaagctttggcttctctgataagcagtactgtaggccccaagtgaaa

SEQ ID NO: 25963 - DNA, 59 bp, synthetic construct; identical to SEQ ID NO: 25960
  source 1..59: mol_type = other DNA

SEQ ID NO: 25964 - DNA, 59 bp, synthetic construct; identical to SEQ ID NO: 25960
  source 1..59: mol_type = other DNA

SEQ ID NO: 25965 - DNA, 59 bp, synthetic construct; identical to SEQ ID NO: 25960
  source 1..59: mol_type = other DNA

SEQ ID NO: 25966 - DNA, 60 bp, synthetic construct
  source 1..60: mol_type = other DNA
gcagcagggaatactgatcctgatttaacagtgataataacttttcacttggggcctaca

SEQ ID NO: 25967 - DNA, 60 bp, synthetic construct; identical to SEQ ID NO: 25966
  source 1..60: mol_type = other DNA

SEQ ID NO: 25968 - DNA, 60 bp, synthetic construct; identical to SEQ ID NO: 25966
  source 1..60: mol_type = other DNA

SEQ ID NO: 25969 - DNA, 60 bp, synthetic construct; identical to SEQ ID NO: 25966
  source 1..60: mol_type = other DNA

SEQ ID NO: 25970 - DNA, 60 bp, synthetic construct; identical to SEQ ID NO: 25966
  source 1..60: mol_type = other DNA

SEQ ID NO: 25971 - DNA, 60 bp, synthetic construct
  source 1..60: mol_type = other DNA
gctccagggggagaagctttggcttctctgataagcagtactgtaggccccaagtgaaaa

SEQ ID NO: 25972 - DNA, 60 bp, synthetic construct; identical to SEQ ID NO: 25966
  source 1..60: mol_type = other DNA

SEQ ID NO: 25973 - DNA, 60 bp, synthetic construct; identical to SEQ ID NO: 25966
  source 1..60: mol_type = other DNA

SEQ ID NO: 25974 - DNA, 61 bp, synthetic construct
  source 1..61: mol_type = other DNA
gcagcagggaatactgatcctgatttaacagtgataataacttttcacttggggcctacag

SEQ ID NO: 25975 - DNA, 61 bp, synthetic construct; identical to SEQ ID NO: 25974
  source 1..61: mol_type = other DNA

SEQ ID NO: 25976 - DNA, 61 bp, synthetic construct; identical to SEQ ID NO: 25974
  source 1..61: mol_type = other DNA

SEQ ID NO: 25977 - DNA, 61 bp, synthetic construct; identical to SEQ ID NO: 25974
  source 1..61: mol_type = other DNA

SEQ ID NO: 25978 - DNA, 61 bp, synthetic construct; identical to SEQ ID NO: 25974
  source 1..61: mol_type = other DNA

SEQ ID NO: 25979 - DNA, 61 bp, synthetic construct
  source 1..61: mol_type = other DNA
gctccagggggagaagctttggcttctctgataagcagtactgtaggccccaagtgaaaag

SEQ ID NO: 25980 - DNA, 61 bp, synthetic construct; identical to SEQ ID NO: 25979
  source 1..61: mol_type = other DNA

SEQ ID NO: 25981 - DNA, 61 bp, synthetic construct; identical to SEQ ID NO: 25974
  source 1..61: mol_type = other DNA

SEQ ID NO: 25982 - DNA, 61 bp, synthetic construct; identical to SEQ ID NO: 25979
  source 1..61: mol_type = other DNA

SEQ ID NO: 25983 - DNA, 62 bp, synthetic construct
  source 1..62: mol_type = other DNA
gcagcagggaatactgatcctgatttaacagtgataataacttttcacttggggcctacagt

SEQ ID NO: 25984 - DNA, 62 bp, synthetic construct; identical to SEQ ID NO: 25983
  source 1..62: mol_type = other DNA

SEQ ID NO: 25985 - DNA, 62 bp, synthetic construct; identical to SEQ ID NO: 25983
  source 1..62: mol_type = other DNA

SEQ ID NO: 25986 - DNA, 62 bp, synthetic construct
  source 1..62: mol_type = other DNA
gctccagggggagaagctttggcttctctgataagcagtactgtaggccccaagtgaaaagt

SEQ ID NO: 25987 - DNA, 63 bp, synthetic construct
  source 1..63: mol_type = other DNA
gcagcagggaatactgatcctgatttaacagtgataataacttttcacttggggcctacagta

SEQ ID NO: 25988 - DNA, 63 bp, synthetic construct; identical to SEQ ID NO: 25987
  source 1..63: mol_type = other DNA

SEQ ID NO: 25989 - DNA, 63 bp, synthetic construct; identical to SEQ ID NO: 25987
  source 1..63: mol_type = other DNA

SEQ ID NO: 25990 - DNA, 63 bp, synthetic construct
  source 1..63: mol_type = other DNA
gctccagggggagaagctttggcttctctgataagcagtactgtaggccccaagtgaaaagtt

SEQ ID NO: 25991 - DNA, 63 bp, synthetic construct; identical to SEQ ID NO: 25990
  source 1..63: mol_type = other DNA

SEQ ID NO: 25992 - DNA, 64 bp, synthetic construct
  source 1..64: mol_type = other DNA
gcagcagggaatactgatcctgatttaacagtgataataacttttcacttggggcctacagtac

SEQ ID NO: 25993 - DNA, 64 bp, synthetic construct; identical to SEQ ID NO: 25992
  source 1..64: mol_type = other DNA

SEQ ID NO: 25994 - DNA, 64 bp, synthetic construct
  source 1..64: mol_type = other DNA
gctccagggggagaagctttggcttctctgataagcagtactgtaggccccaagtgaaaagtta

SEQ ID NO: 25995 - DNA, 65 bp, synthetic construct
  source 1..65: mol_type = other DNA
gcagcagggaatactgatcctgatttaacagtgataataacttttcacttggggcctacagtact

SEQ ID NO: 25996 - DNA, 65 bp, synthetic construct
  source 1..65: mol_type = other DNA
gctccagggggagaagctttggcttctctgataagcagtactgtaggccccaagtgaaaagttat

SEQ ID NO: 25997 - DNA, 66 bp, synthetic construct
  source 1..66: mol_type = other DNA
gcagcagggaatactgatcctgatttaacagtgataataacttttcacttggggcctacagtactg

SEQ ID NO: 25998 - DNA, 66 bp, synthetic construct
  source 1..66: mol_type = other DNA
gctccagggggagaagctttggcttctctgataagcagtactgtaggccccaagtgaaaagttatt

SEQ ID NO: 25999 - DNA, 67 bp, synthetic construct
  source 1..67: mol_type = other DNA
gctccagggggagaagctttggcttctctgataagcagtactgtaggccccaagtgaaaagttatta

SEQ ID NO: 26000 - DNA, 67 bp, synthetic construct
  source 1..67: mol_type = other DNA
gcagcagggaatactgatcctgatttaacagtgataataacttttcacttggggcctacagtactgc

SEQ ID NO: 26001 - DNA, 68 bp, synthetic construct
  source 1..68: mol_type = other DNA
gcagcagggaatactgatcctgatttaacagtgataataacttttcacttggggcctacagtactgct

SEQ ID NO: 26002 - DNA, 68 bp, synthetic construct; identical to SEQ ID NO: 26001
  source 1..68: mol_type = other DNA

SEQ ID NO: 26003 - DNA, 68 bp, synthetic construct
  source 1..68: mol_type = other DNA
gctccagggggagaagctttggcttctctgataagcagtactgtaggccccaagtgaaaagttattat

SEQ ID NO: 26004 - DNA, 68 bp, synthetic construct; identical to SEQ ID NO: 26001
  source 1..68: mol_type = other DNA

SEQ ID NO: 26005 - DNA, 68 bp, synthetic construct; identical to SEQ ID NO: 26003
  source 1..68: mol_type = other DNA

SEQ ID NO: 26006 - DNA, 68 bp, synthetic construct; identical to SEQ ID NO: 26001
  source 1..68: mol_type = other DNA

SEQ ID NO: 26007 - DNA, 68 bp, synthetic construct; identical to SEQ ID NO: 26003
  source 1..68: mol_type = other DNA

SEQ ID NO: 26008 - DNA, 69 bp, synthetic construct
  source 1..69: mol_type = other DNA
gctccagggggagaagctttggcttctctgataagcagtactgtaggccccaagtgaaaagttattatc

SEQ ID NO: 26009 - DNA, 69 bp, synthetic construct
  source 1..69: mol_type = other DNA
gcagcagggaatactgatcctgatttaacagtgataataacttttcacttggggcctacagtactgctt

SEQ ID NO: 26010 - DNA, 69 bp, synthetic construct; identical to SEQ ID NO: 26009
  source 1..69: mol_type = other DNA

SEQ ID NO: 26011 - DNA, 69 bp, synthetic construct; identical to SEQ ID NO: 26008
  source 1..69: mol_type = other DNA

SEQ ID NO: 26012 - DNA, 70 bp, synthetic construct
  source 1..70: mol_type = other DNA
gcagcagggaatactgatcctgatttaacagtgataataacttttcacttggggcctacagtactgctta

SEQ ID NO: 26013 - DNA, 70 bp, synthetic construct
  source 1..70: mol_type = other DNA
gctccagggggagaagctttggcttctctgataagcagtactgtaggccccaagtgaaaagttattatca

SEQ ID NO: 26014 - DNA, 70 bp, synthetic construct; identical to SEQ ID NO: 26012
  source 1..70: mol_type = other DNA

SEQ ID NO: 26015 - DNA, 71 bp, synthetic construct
  source 1..71: mol_type = other DNA
gcagcagggaatactgatcctgatttaacagtgataataacttttcacttggggcctacagtactgcttat

SEQ ID NO: 26016 - DNA, 71 bp, synthetic construct; identical to SEQ ID NO: 26015
  source 1..71: mol_type = other DNA

SEQ ID NO: 26017 - DNA, 71 bp, synthetic construct; identical to SEQ ID NO: 26015
  source 1..71: mol_type = other DNA

SEQ ID NO: 26018 - DNA, 71 bp, synthetic construct; identical to SEQ ID NO: 26015
  source 1..71: mol_type = other DNA

SEQ ID NO: 26019 - DNA, 71 bp, synthetic construct
  source 1..71: mol_type = other DNA
gctccagggggagaagctttggcttctctgataagcagtactgtaggccccaagtgaaaagttattatcac

SEQ ID NO: 26020 - DNA, 72 bp, synthetic construct
  source 1..72: mol_type = other DNA
gctccagggggagaagctttggcttctctgataagcagtactgtaggccccaagtgaaaagttattatcact

SEQ ID NO: 26021 - DNA, 72 bp, synthetic construct; identical to SEQ ID NO: 26020
  source 1..72: mol_type = other DNA

SEQ ID NO: 26022 - DNA, 72 bp, synthetic construct
  source 1..72: mol_type = other DNA
gcagcagggaatactgatcctgatttaacagtgataataacttttcacttggggcctacagtactgcttatc

SEQ ID NO: 26023 - DNA, 72 bp, synthetic construct; identical to SEQ ID NO: 26022
  source 1..72: mol_type = other DNA

SEQ ID NO: 26024 - DNA, 72 bp, synthetic construct; identical to SEQ ID NO: 26020
  source 1..72: mol_type = other DNA

SEQ ID NO: 26025 - DNA, 73 bp, synthetic construct
  source 1..73: mol_type = other DNA
gcagcagggaatactgatcctgatttaacagtgataataacttttcacttggggcctacagtactgcttatca

SEQ ID NO: 26026 - DNA, 73 bp, synthetic construct
  source 1..73: mol_type = other DNA
gctccagggggagaagctttggcttctctgataagcagtactgtaggccccaagtgaaaagttattatcactg

SEQ ID NO: 26027 - DNA, 73 bp, synthetic construct; identical to SEQ ID NO: 26025
  source 1..73: mol_type = other DNA

SEQ ID NO: 26028 - DNA, 73 bp, synthetic construct; identical to SEQ ID NO: 26026
  source 1..73: mol_type = other DNA

SEQ ID NO: 26029 - DNA, 73 bp, synthetic construct; identical to SEQ ID NO: 26025
  source 1..73: mol_type = other DNA

SEQ ID NO: 26030 - DNA, 73 bp, synthetic construct; identical to SEQ ID NO: 26025
  source 1..73: mol_type = other DNA

SEQ ID NO: 26031 - DNA, 74 bp, synthetic construct
  source 1..74: mol_type = other DNA
gcagcagggaatactgatcctgatttaacagtgataataacttttcacttggggcctacagtactgcttatcag

SEQ ID NO: 26032 - DNA, 74 bp, synthetic construct
  source 1..74: mol_type = other DNA
gctccagggggagaagctttggcttctctgataagcagtactgtaggccccaagtgaaaagttattatcactgt

SEQ ID NO: 26033 - DNA, 74 bp, synthetic construct; identical to SEQ ID NO: 26032
  source 1..74: mol_type = other DNA

SEQ ID NO: 26034 - DNA, 74 bp, synthetic construct; identical to SEQ ID NO: 26031
  source 1..74: mol_type = other DNA

SEQ ID NO: 26035 - DNA, 75 bp, synthetic construct
  source 1..75: mol_type = other DNA
gcagcagggaatactgatcctgatttaacagtgataataacttttcacttggggcctacagtactgcttatcaga

SEQ ID NO: 26036 - DNA, 75 bp, synthetic construct
  source 1..75: mol_type = other DNA
gctccagggggagaagctttggcttctctgataagcagtactgtaggccccaagtgaaaagttattatcactgtt

SEQ ID NO: 26037 - DNA, 75 bp, synthetic construct; identical to SEQ ID NO: 26036
  source 1..75: mol_type = other DNA

SEQ ID NO: 26038 - DNA, 75 bp, synthetic construct; identical to SEQ ID NO: 26036
  source 1..75: mol_type = other DNA

SEQ ID NO: 26039 - DNA, 75 bp, synthetic construct; identical to SEQ ID NO: 26035
  source 1..75: mol_type = other DNA

SEQ ID NO: 26040 - DNA, 75 bp, synthetic construct; identical to SEQ ID NO: 26036
  source 1..75: mol_type = other DNA

SEQ ID NO: 26041 - DNA, 76 bp, synthetic construct
  source 1..76: mol_type = other DNA
gctccagggggagaagctttggcttctctgataagcagtactgtaggccccaagtgaaaagttattatcactgtta

SEQ ID NO: 26042 - DNA, 76 bp, synthetic construct; identical to SEQ ID NO: 26041
  source 1..76: mol_type = other DNA

SEQ ID NO: 26043 - DNA, 76 bp, synthetic construct
  source 1..76: mol_type = other DNA
gcagcagggaatactgatcctgatttaacagtgataataacttttcacttggggcctacagtactgcttatcagag

SEQ ID NO: 26044 - DNA, 76 bp, synthetic construct; identical to SEQ ID NO: 26043
  source 1..76: mol_type = other DNA

SEQ ID NO: 26045 - DNA, 77 bp, synthetic construct
  source 1..77: mol_type = other DNA
gctccagggggagaagctttggcttctctgataagcagtactgtaggccccaagtgaaaagttattatcactgttaa

SEQ ID NO: 26046 - DNA, 77 bp, synthetic construct
  source 1..77: mol_type = other DNA
gcagcagggaatactgatcctgatttaacagtgataataacttttcacttggggcctacagtactgcttatcagaga

SEQ ID NO: 26047 - DNA, 77 bp, synthetic construct; identical to SEQ ID NO: 26046
  source 1..77: mol_type = other DNA

SEQ ID NO: 26048 - DNA, 77 bp, synthetic construct; identical to SEQ ID NO: 26045
  source 1..77: mol_type = other DNA

SEQ ID NO: 26049 - DNA, 78 bp, synthetic construct
  source 1..78: mol_type = other DNA
gcagcagggaatactgatcctgatttaacagtgataataacttttcacttggggcctacagtactgcttatcagagaa

SEQ ID NO: 26050 - DNA, 78 bp, synthetic construct
  source 1..78: mol_type = other DNA
gctccagggggagaagctttggcttctctgataagcagtactgtaggccccaagtgaaaagttattatcactgttaaa

SEQ ID NO: 26051 - DNA, 78 bp, synthetic construct; identical to SEQ ID NO: 26049
  source 1..78: mol_type = other DNA

SEQ ID NO: 26052 - DNA, 78 bp, synthetic construct; identical to SEQ ID NO: 26050
  source 1..78: mol_type = other DNA

SEQ ID NO: 26053 - DNA, 78 bp, synthetic construct; identical to SEQ ID NO: 26050
  source 1..78: mol_type = other DNA

SEQ ID NO: 26054 - DNA, 78 bp, synthetic construct; identical to SEQ ID NO: 26049
  source 1..78: mol_type = other DNA

SEQ ID NO: 26055 - DNA, 79 bp, synthetic construct
  source 1..79: mol_type = other DNA
gctccagggggagaagctttggcttctctgataagcagtactgtaggccccaagtgaaaagttattatcactgttaaat

SEQ ID NO: 26056 - DNA, 79 bp, synthetic construct
  source 1..79: mol_type = other DNA
gcagcagggaatactgatcctgatttaacagtgataataacttttcacttggggcctacagtactgcttatcagagaag

SEQ ID NO: 26057 - DNA, 80 bp, synthetic construct
  source 1..80: mol_type = other DNA
gcagcagggaatactgatcctgatttaacagtgataataacttttcacttggggcctacagtactgcttatcagagaagc

SEQ ID NO: 26058 - DNA, 80 bp, synthetic construct
  source 1..80: mol_type = other DNA
gctccagggggagaagctttggcttctctgataagcagtactgtaggccccaagtgaaaagttattatcactgttaaatc

SEQ ID NO: 26059 - DNA, 80 bp, synthetic construct; identical to SEQ ID NO: 26058
  source 1..80: mol_type = other DNA

SEQ ID NO: 26060 - DNA, 80 bp, synthetic construct; identical to SEQ ID NO: 26058
  source 1..80: mol_type = other DNA

SEQ ID NO: 26061 - DNA, 81 bp, synthetic construct
  source 1..81: mol_type = other DNA
gctccagggggagaagctttggcttctctgataagcagtactgtaggccccaagtgaaaagttattatcactgttaaatca

SEQ ID NO: 26062 - DNA, 81 bp, synthetic construct
  source 1..81: mol_type = other DNA
gcagcagggaatactgatcctgatttaacagtgataataacttttcacttggggcctacagtactgcttatcagagaagcc

SEQ ID NO: 26063 - DNA, 81 bp, synthetic construct; identical to SEQ ID NO: 26061
  source 1..81: mol_type = other DNA

SEQ ID NO: 26064 - DNA, 81 bp, synthetic construct; identical to SEQ ID NO: 26062
  source 1..81: mol_type = other DNA

SEQ ID NO: 26065 - DNA, 81 bp, synthetic construct; identical to SEQ ID NO: 26062
  source 1..81: mol_type = other DNA

SEQ ID NO: 26066 - DNA, 17 bp, synthetic construct
  source 1..17: mol_type = other DNA
aagtgaaaagttattat

SEQ ID NO: 26067 - DNA, 17 bp, synthetic construct
  source 1..17: mol_type = other DNA
ggcctacagtactgctt

SEQ ID NO: 26068 - DNA, 17 bp, synthetic construct
  source 1..17: mol_type = other DNA
agtgaaaagttattatc

SEQ ID NO: 26069 - DNA, 17 bp, synthetic construct
  source 1..17: mol_type = other DNA
ggcctacagtactgctt

SEQ ID NO: 26070 - DNA, 17 bp, synthetic construct
  source 1..17: mol_type = other DNA
agtgaaaagttattatc

SEQ ID NO: 26071 - DNA, 17 bp, synthetic construct
  source 1..17: mol_type = other DNA
ggcctacagtactgctt

SEQ ID NO: 26072 - DNA, 17 bp, synthetic construct
  source 1..17: mol_type = other DNA
gtgaaaagttattatca

SEQ ID NO: 26073 - DNA, 17 bp, synthetic construct
  source 1..17: mol_type = other DNA
gtgaaaagttattatca

SEQ ID NO: 26074 - DNA, 17 bp, synthetic construct
  source 1..17: mol_type = other DNA
gtgaaaagttattatca

SEQ ID NO: 26075 - DNA, 17 bp, synthetic construct
  source 1..17: mol_type = other DNA
gcctacagtactgctta

SEQ ID NO: 26076 - DNA, 17 bp, synthetic construct
  source 1..17: mol_type = other DNA
gcctacagtactgctta

SEQ ID NO: 26077 - DNA, 17 bp, synthetic construct
  source 1..17: mol_type = other DNA
gtgaaaagttattatca

SEQ ID NO: 26078 - DNA, 17 bp, synthetic construct
  source 1..17: mol_type = other DNA
gtgaaaagttattatca

SEQ ID NO: 26079 - DNA, 17 bp, synthetic construct
  source 1..17: mol_type = other DNA
tgaaaagttattatcac

SEQ ID NO: 26080 - DNA, 17 bp, synthetic construct
  source 1..17: mol_type = other DNA
tgaaaagttattatcac

SEQ ID NO: 26081 - DNA, 17 bp, synthetic construct
  source 1..17: mol_type = other DNA
tgaaaagttattatcac

SEQ ID NO: 26082 - DNA, 17 bp, synthetic construct
  source 1..17: mol_type = other DNA
cctacagtactgcttat

SEQ ID NO: 26083 - DNA, 17 bp, synthetic construct
  source 1..17: mol_type = other DNA
tgaaaagttattatcac

SEQ ID NO: 26084 - DNA, 17 bp, synthetic construct
  source 1..17: mol_type = other DNA
tgaaaagttattatcac

SEQ ID NO: 26085 - DNA, 17 bp, synthetic construct
  source 1..17: mol_type = other DNA
tgaaaagttattatcac

SEQ ID NO: 26086 - DNA, 17 bp, synthetic construct
  source 1..17: mol_type = other DNA
tgaaaagttattatcac

SEQ ID NO: 26087 - DNA, 17 bp, synthetic construct
  source 1..17: mol_type = other DNA
cctacagtactgcttat

SEQ ID NO: 26088 - DNA, 17 bp, synthetic construct
  source 1..17: mol_type = other DNA
tgaaaagttattatcac

SEQ ID NO: 26089 - DNA, 17 bp, synthetic construct
  source 1..17: mol_type = other DNA
tgaaaagttattatcac

SEQ ID NO: 26090 - DNA, 17 bp, synthetic construct
  source 1..17: mol_type = other DNA
gaaaagttattatcact

SEQ ID NO: 26091 - DNA, 17 bp, synthetic construct
  source 1..17: mol_type = other DNA
gaaaagttattatcact

SEQ ID NO: 26092 - DNA, 17 bp, synthetic construct
  source 1..17: mol_type = other DNA
ctacagtactgcttatc

SEQ ID NO: 26093 - DNA, 17 bp, synthetic construct
  source 1..17: mol_type = other DNA
ctacagtactgcttatc

SEQ ID NO: 26094 - DNA, 17 bp, synthetic construct
  source 1..17: mol_type = other DNA
gaaaagttattatcact

SEQ ID NO: 26095 - DNA, 17 bp, synthetic construct
  source 1..17: mol_type = other DNA
gaaaagttattatcact

SEQ ID NO: 26096 - DNA, 17 bp, synthetic construct
  source 1..17: mol_type = other DNA
gaaaagttattatcact

SEQ ID NO: 26097 - DNA, 17 bp, synthetic construct
  source 1..17: mol_type = other DNA
gaaaagttattatcact

SEQ ID NO: 26098 - DNA, 17 bp, synthetic construct
  source 1..17: mol_type = other DNA
ctacagtactgcttatc

SEQ ID NO: 26099 - DNA, 17 bp, synthetic construct
  source 1..17: mol_type = other DNA
tacagtactgcttatca

SEQ ID NO: 26100 - DNA, 17 bp, synthetic construct
  source 1..17: mol_type = other DNA
aaaagttattatcactg

SEQ ID NO: 26101 - DNA, 17 bp, synthetic construct
  source 1..17: mol_type = other DNA
aaaagttattatcactg

SEQ ID NO: 26102 - DNA, 17 bp, synthetic construct
  source 1..17: mol_type = other DNA
tacagtactgcttatca

SEQ ID NO: 26103 - DNA, 17 bp, synthetic construct
  source 1..17: mol_type = other DNA
aaaagttattatcactg

SEQ ID NO: 26104 - DNA, 17 bp, synthetic construct
  source 1..17: mol_type = other DNA
aaagttattatcactgt

SEQ ID NO: 26105 - DNA, 17 bp, synthetic construct
  source 1..17: mol_type = other DNA
acagtactgcttatcag

SEQ ID NO: 26106 - DNA, 17 bp, synthetic construct
  source 1..17: mol_type = other DNA
aaagttattatcactgt

SEQ ID NO: 26107 - DNA, 17 bp, synthetic construct
  source 1..17: mol_type = other DNA
cagtactgcttatcaga

SEQ ID NO: 26108 - DNA, 17 bp, synthetic construct
  source 1..17: mol_type = other DNA
aagttattatcactgtt

SEQ ID NO: 26109 - DNA, 17 bp, synthetic construct
  source 1..17: mol_type = other DNA
agtactgcttatcagag

SEQ ID NO: 26110 - DNA, 17 bp, synthetic construct
  source 1..17: mol_type = other DNA
agtactgcttatcagag

SEQ ID NO: 26111 - DNA, 17 bp, synthetic construct
  source 1..17: mol_type = other DNA
agttattatcactgtta

SEQ ID NO: 26112 - DNA, 17 bp, synthetic construct
  source 1..17: mol_type = other DNA
agtactgcttatcagag

SEQ ID NO: 26113 - DNA, 17 bp, synthetic construct
  source 1..17: mol_type = other DNA
agtactgcttatcagag

SEQ ID NO: 26114 - DNA, 17 bp, synthetic construct
  source 1..17: mol_type = other DNA
agtactgcttatcagag

SEQ ID NO: 26115 - DNA, 17 bp, synthetic construct
  source 1..17: mol_type = other DNA
gtactgcttatcagaga

SEQ ID NO: 26116 - DNA, 17 bp, synthetic construct
  source 1..17: mol_type = other DNA
gtactgcttatcagaga

SEQ ID NO: 26117 - DNA, 17 bp, synthetic construct
  source 1..17: mol_type = other DNA
gtactgcttatcagaga

SEQ ID NO: 26118 - DNA, 17 bp, synthetic construct
  source 1..17: mol_type = other DNA
gtactgcttatcagaga

SEQ ID NO: 26119 - DNA, 17 bp, synthetic construct
  source 1..17: mol_type = other DNA
gtactgcttatcagaga

SEQ ID NO: 26120 - DNA, 17 bp, synthetic construct
  source 1..17: mol_type = other DNA
gttattatcactgttaa

SEQ ID NO: 26121 - DNA, 17 bp, synthetic construct
  source 1..17: mol_type = other DNA
gtactgcttatcagaga

SEQ ID NO: 26122 - DNA, 17 bp, synthetic construct
  source 1..17: mol_type = other DNA
gtactgcttatcagaga

SEQ ID NO: 26123 - DNA, 17 bp, synthetic construct
  source 1..17: mol_type = other DNA
tactgcttatcagagaa

SEQ ID NO: 26124 - DNA, 17 bp, synthetic construct
  source 1..17: mol_type = other DNA
tactgcttatcagagaa

SEQ ID NO: 26125 - DNA, 17 bp, synthetic construct
  source 1..17: mol_type = other DNA
tactgcttatcagagaa

SEQ ID NO: 26126 - DNA, 17 bp, synthetic construct
  source 1..17: mol_type = other DNA
tactgcttatcagagaa

SEQ ID NO: 26127 - DNA, 17 bp, synthetic construct
  source 1..17: mol_type = other DNA
tactgcttatcagagaa

SEQ ID NO: 26128 - DNA, 17 bp, synthetic construct
  source 1..17: mol_type = other DNA
ttattatcactgttaaa

SEQ ID NO: 26129 - DNA, 17 bp, synthetic construct
  source 1..17: mol_type = other DNA
ttattatcactgttaaa

SEQ ID NO: 26130 - DNA, 17 bp, synthetic construct
  source 1..17: mol_type = other DNA
tactgcttatcagagaa

SEQ ID NO: 26131 - DNA, 17 bp, synthetic construct
  source 1..17: mol_type = other DNA
ttattatcactgttaaa

SEQ ID NO: 26132 - DNA, 17 bp, synthetic construct
  source 1..17: mol_type = other DNA
actgcttatcagagaag

SEQ ID NO: 26133 - DNA, 17 bp, synthetic construct
  source 1..17: mol_type = other DNA
actgcttatcagagaag

SEQ ID NO: 26134 - DNA, 17 bp, synthetic construct
  source 1..17: mol_type = other DNA
actgcttatcagagaag

SEQ ID NO: 26135 - DNA, 17 bp, synthetic construct
  source 1..17: mol_type = other DNA
tattatcactgttaaat

SEQ ID NO: 26136 - DNA, 17 bp, synthetic construct
  source 1..17: mol_type = other DNA
ctgcttatcagagaagc

SEQ ID NO: 26137 - DNA, 17 bp, synthetic construct
  source 1..17: mol_type = other DNA
ctgcttatcagagaagc

SEQ ID NO: 26138 - DNA, 17 bp, synthetic construct
  source 1..17: mol_type = other DNA
ctgcttatcagagaagc

SEQ ID NO: 26139 - DNA, 17 bp, synthetic construct
  source 1..17: mol_type = other DNA
attatcactgttaaatc

SEQ ID NO: 26140 - DNA, 17 bp, synthetic construct
  source 1..17: mol_type = other DNA
attatcactgttaaatc

SEQ ID NO: 26141 - DNA, 17 bp, synthetic construct
  source 1..17: mol_type = other DNA
tgcttatcagagaagcc

SEQ ID NO: 26142 - DNA, 17 bp, synthetic construct
  source 1..17: mol_type = other DNA
tgcttatcagagaagcc

SEQ ID NO: 26143 - DNA, 17 bp, synthetic construct
  source 1..17: mol_type = other DNA
ttatcactgttaaatca

SEQ ID NO: 26144 - DNA, 17 bp, synthetic construct
  source 1..17: mol_type = other DNA
gcttatcagagaagcca

SEQ ID NO: 26145 - DNA, 17 bp, synthetic construct
  source 1..17: mol_type = other DNA
tatcactgttaaatcag

SEQ ID NO: 26146 - DNA, 17 bp, synthetic construct
  source 1..17: mol_type = other DNA
cttatcagagaagccaa

SEQ ID NO: 26147 - DNA, 17 bp, synthetic construct
  source 1..17: mol_type = other DNA
atcactgttaaatcagg

SEQ ID NO: 26148 - DNA, 17 bp, synthetic construct
  source 1..17: mol_type = other DNA
tcactgttaaatcagga

SEQ ID NO: 26149 - DNA, 17 bp, synthetic construct
  source 1..17: mol_type = other DNA
ttatcagagaagccaaa

SEQ ID NO: 26150 - DNA, 17 bp, synthetic construct
  source 1..17: mol_type = other DNA
tatcagagaagccaaag

SEQ ID NO: 26151 - DNA, 17 bp, synthetic construct
  source 1..17: mol_type = other DNA
tatcagagaagccaaag

SEQ ID NO: 26152 - DNA, 17 bp, synthetic construct
  source 1..17: mol_type = other DNA
cactgttaaatcaggat

SEQ ID NO: 26153 - DNA, 17 bp, synthetic construct
  source 1..17: mol_type = other DNA
tatcagagaagccaaag

SEQ ID NO: 26154 - DNA, 17 bp, synthetic construct
  source 1..17: mol_type = other DNA
cactgttaaatcaggat

SEQ ID NO: 26155 - DNA, 17 bp, synthetic construct
  source 1..17: mol_type = other DNA
tatcagagaagccaaag

SEQ ID NO: 26156 - DNA, 17 bp, synthetic construct
  source 1..17: mol_type = other DNA
cactgttaaatcaggat

SEQ ID NO: 26157 - DNA, 17 bp, synthetic construct
  source 1..17: mol_type = other DNA
actgttaaatcaggatc

SEQ ID NO: 26158 - DNA, 17 bp, synthetic construct
  source 1..17: mol_type = other DNA
atcagagaagccaaagc

SEQ ID NO: 26159 - DNA, 17 bp, synthetic construct
  source 1..17: mol_type = other DNA
atcagagaagccaaagc

SEQ ID NO: 26160 - DNA, 17 bp, synthetic construct
  source 1..17: mol_type = other DNA
actgttaaatcaggatc

SEQ ID NO: 26161 - DNA, 17 bp, synthetic construct
  source 1..17: mol_type = other DNA
tcagagaagccaaagct

SEQ ID NO: 26162 - DNA, 17 bp, synthetic construct
  source 1..17: mol_type = other DNA
ctgttaaatcaggatca

SEQ ID NO: 26163 - DNA, 17 bp, synthetic construct
  source 1..17: mol_type = other DNA
tcagagaagccaaagct

SEQ ID NO: 26164 - DNA, 17 bp, synthetic construct
  source 1..17: mol_type = other DNA
cagagaagccaaagctt

SEQ ID NO: 26165 - DNA, 17 bp, synthetic construct
  source 1..17: mol_type = other DNA
cagagaagccaaagctt

SEQ ID NO: 26166 - DNA, 17 bp, synthetic construct
  source 1..17: mol_type = other DNA
cagagaagccaaagctt

SEQ ID NO: 26167 - DNA, 17 bp, synthetic construct
  source 1..17: mol_type = other DNA
cagagaagccaaagctt

SEQ ID NO: 26168 - DNA, 17 bp, synthetic construct
  source 1..17: mol_type = other DNA
tgttaaatcaggatcag

SEQ ID NO: 26169 - DNA, 17 bp, synthetic construct
  source 1..17: mol_type = other DNA
gttaaatcaggatcagt

SEQ ID NO: 26170 - DNA, 17 bp, synthetic construct
  source 1..17: mol_type = other DNA
gttaaatcaggatcagt

SEQ ID NO: 26171 - DNA, 17 bp, synthetic construct
  source 1..17: mol_type = other DNA
agagaagccaaagcttc

SEQ ID NO: 26172 - DNA, 17 bp, synthetic construct
  source 1..17: mol_type = other DNA
agagaagccaaagcttc

SEQ ID NO: 26173 - DNA, 17 bp, synthetic construct
  source 1..17: mol_type = other DNA
gttaaatcaggatcagt

SEQ ID NO: 26174 - DNA, 17 bp, synthetic construct
  source 1..17: mol_type = other DNA
gagaagccaaagcttct

SEQ ID NO: 26175 - DNA, 17 bp, synthetic construct
  source 1..17: mol_type = other DNA
ttaaatcaggatcagta

SEQ ID NO: 26176 - DNA, 17 bp, synthetic construct
  source 1..17: mol_type = other DNA
gagaagccaaagcttct

SEQ ID NO: 26177 - DNA, 17 bp, synthetic construct
  source 1..17: mol_type = other DNA
ttaaatcaggatcagta

SEQ ID NO: 26178 - DNA, 17 bp, synthetic construct
  source 1..17: mol_type = other DNA
gagaagccaaagcttct

SEQ ID NO: 26179 - DNA, 17 bp, synthetic construct
  source 1..17: mol_type = other DNA
gagaagccaaagcttct

SEQ ID NO: 26180 - DNA, 17 bp, synthetic construct
  source 1..17: mol_type = other DNA
agaagccaaagcttctc

SEQ ID NO: 26181 - DNA, 17 bp, synthetic construct
  source 1..17: mol_type = other DNA
taaatcaggatcagtat

SEQ ID NO: 26182 - DNA, 17 bp, synthetic construct
  source 1..17: mol_type = other DNA
taaatcaggatcagtat

SEQ ID NO: 26183 - DNA, 17 bp, synthetic construct
  source 1..17: mol_type = other DNA
agaagccaaagcttctc

SEQ ID NO: 26184 - DNA, 17 bp, synthetic construct
  source 1..17: mol_type = other DNA
gaagccaaagcttctcc

SEQ ID NO: 26185 - DNA, 17 bp, synthetic construct
  source 1..17: mol_type = other DNA
aaatcaggatcagtatt

SEQ ID NO: 26186 - DNA, 17 bp, synthetic construct
  source 1..17: mol_type = other DNA
aaatcaggatcagtatt

SEQ ID NO: 26187 - DNA, 17 bp, synthetic construct
  source 1..17: mol_type = other DNA
aaatcaggatcagtatt

SEQ ID NO: 26188 - DNA, 17 bp, synthetic construct
  source 1..17: mol_type = other DNA
gaagccaaagcttctcc

SEQ ID NO: 26189 - DNA, 17 bp, synthetic construct
  source 1..17: mol_type = other DNA
aaatcaggatcagtatt

SEQ ID NO: 26190 - DNA, 17 bp, synthetic construct
  source 1..17: mol_type = other DNA
aatcaggatcagtattc

SEQ ID NO: 26191 - DNA, 17 bp, synthetic construct
  source 1..17: mol_type = other DNA
aatcaggatcagtattc

SEQ ID NO: 26192 - DNA, 17 bp, synthetic construct
  source 1..17: mol_type = other DNA
aagccaaagcttctccc

SEQ ID NO: 26193 - DNA, 17 bp, synthetic construct
  source 1..17: mol_type = other DNA
aagccaaagcttctccc

SEQ ID NO: 26194 - DNA, 17 bp, synthetic construct
  source 1..17: mol_type = other DNA
atcaggatcagtattcc

SEQ ID NO: 26195 - DNA, 17 bp, synthetic construct
  source 1..17: mol_type = other DNA
agccaaagcttctcccc

SEQ ID NO: 26196 - DNA, 17 bp, synthetic construct
  source 1..17: mol_type = other DNA
agccaaagcttctcccc

SEQ ID NO: 26197 - DNA, 17 bp, synthetic construct
  source 1..17: mol_type = other DNA
atcaggatcagtattcc

SEQ ID NO: 26198 - DNA, 17 bp, synthetic construct
  source 1..17: mol_type = other DNA
gccaaagcttctccccc

SEQ ID NO: 26199 - DNA, 17 bp, synthetic construct
  source 1..17: mol_type = other DNA
tcaggatcagtattccc

SEQ ID NO: 26200 - DNA, 17 bp, synthetic construct
  source 1..17: mol_type = other DNA
gccaaagcttctccccc

SEQ ID NO: 26201 - DNA, 17 bp, synthetic construct
  source 1..17: mol_type = other DNA
tcaggatcagtattccc

SEQ ID NO: 26202 - DNA, 17 bp, synthetic construct
  source 1..17: mol_type = other DNA
tcaggatcagtattccc

SEQ ID NO: 26203 - DNA, 17 bp, synthetic construct
  source 1..17: mol_type = other DNA
gccaaagcttctccccc

SEQ ID NO: 26204 - DNA, 17 bp, synthetic construct
  source 1..17: mol_type = other DNA
caggatcagtattccct

SEQ ID NO: 26205 - DNA, 17 bp, synthetic construct
  source 1..17: mol_type = other DNA
ccaaagcttctccccct

SEQ ID NO: 26206 - DNA, 17 bp, synthetic construct
  source 1..17: mol_type = other DNA
caaagcttctccccctg

SEQ ID NO: 26207 - DNA, 17 bp, synthetic construct
  source 1..17: mol_type = other DNA
aggatcagtattccctg

SEQ ID NO: 26208 - DNA, 17 bp, synthetic construct
  source 1..17: mol_type = other DNA
aggatcagtattccctg

SEQ ID NO: 26209 - DNA, 17 bp, synthetic construct
  source 1..17: mol_type = other DNA
aggatcagtattccctg

SEQ ID NO: 26210 - DNA, 17 bp, synthetic construct
  source 1..17: mol_type = other DNA
ggatcagtattccctgc

SEQ ID NO: 26211 - DNA, 17 bp, synthetic construct
  source 1..17: mol_type = other DNA
aaagcttctccccctgg

SEQ ID NO: 26212 - DNA, 17 bp, synthetic construct
  source 1..17: mol_type = other DNA
ggatcagtattccctgc

SEQ ID NO: 26213 - DNA, 17 bp, synthetic construct
  source 1..17: mol_type = other DNA
aaagcttctccccctgg

SEQ ID NO: 26214 - DNA, 17 bp, synthetic construct
  source 1..17: mol_type = other DNA
aaagcttctccccctgg

SEQ ID NO: 26215 - DNA, 20 bp, synthetic construct
  source 1..20: mol_type = other DNA
ctcgtaaggtgtaaattact

SEQ ID NO: 26216 - DNA, 20 bp, synthetic construct
  source 1..20: mol_type = other DNA
ggctgattccattaacagta

SEQ ID NO: 26217 - DNA, 20 bp, synthetic construct
  source 1..20: mol_type = other DNA
ccattaacagtaagtaattt

SEQ ID NO: 26218 - DNA, 20 bp, synthetic construct
  source 1..20: mol_type = other DNA
tcgtaaggtgtaaattactt

SEQ ID NO: 26219 - DNA, 24 bp, synthetic construct
  source 1..24: mol_type = other DNA
ttttggctgattccattaacagta

SEQ ID NO: 26220 - DNA, 20 bp, synthetic construct
  source 1..20: mol_type = other DNA
cagtaagtaatttacacctt

SEQ ID NO: 26221 - DNA, 20 bp, synthetic construct
  source 1..20: mol_type = other DNA
taagtaatttacaccttacg

SEQ ID NO: 26222 - DNA, 20 bp, synthetic construct
  source 1..20: mol_type = other DNA
cattaacagtaagtaattta

SEQ ID NO: 26223 - DNA, 20 bp, synthetic construct
  source 1..20: mol_type = other DNA
gtaaggtgtaaattacttac

SEQ ID NO: 26224 - DNA, 20 bp, synthetic construct
  source 1..20: mol_type = other DNA
agtaagtaatttacacctta

SEQ ID NO: 26225 - DNA, 20 bp, synthetic construct
  source 1..20: mol_type = other DNA
cgtaaggtgtaaattactta

SEQ ID NO: 26226 - DNA, 23 bp, synthetic construct
  source 1..23: mol_type = other DNA
gtggcctcgtaaggtgtaaatta

SEQ ID NO: 26227 - DNA, 24 bp, synthetic construct
  source 1..24: mol_type = other DNA
gtaaattacttactgttaatggaa

SEQ ID NO: 26228 - DNA, 21 bp, synthetic construct
  source 1..21: mol_type = other DNA
agtaagtaatttacaccttac

SEQ ID NO: 26229 - DNA, 21 bp, synthetic construct
  source 1..21: mol_type = other DNA
cagtaagtaatttacacctta

SEQ ID NO: 26230 - DNA, 20 bp, synthetic construct
  source 1..20: mol_type = other DNA
cgtaaggtgtaaattactta

SEQ ID NO: 26231 - DNA, 20 bp, synthetic construct
  source 1..20: mol_type = other DNA
tgtaaattacttactgttaa

SEQ ID NO: 26232 - DNA, 20 bp, synthetic construct
  source 1..20: mol_type = other DNA
gtaaggtgtaaattacttac

SEQ ID NO: 26233 - DNA, 20 bp, synthetic construct
  source 1..20: mol_type = other DNA
cagtaagtaatttacacctt

SEQ ID NO: 26234 - DNA, 20 bp, synthetic construct
  source 1..20: mol_type = other DNA
attaacagtaagtaatttac

SEQ ID NO: 26235 - DNA, 20 bp, synthetic construct
  source 1..20: mol_type = other DNA
gtaaggtgtaaattacttac

SEQ ID NO: 26236 - DNA, 23 bp, synthetic construct
  source 1..23: mol_type = other DNA
gtggcctcgtaaggtgtaaatta

SEQ ID NO: 26237 - DNA, 23 bp, synthetic construct
  source 1..23: mol_type = other DNA
gtggcctcgtaaggtgtaaatta

SEQ ID NO: 26238 - DNA, 24 bp, synthetic construct
  source 1..24: mol_type = other DNA
gtaaattacttactgttaatggaa

SEQ ID NO: 26239 - DNA, 21 bp, synthetic construct
  source 1..21: mol_type = other DNA
aacagtaagtaatttacacct

SEQ ID NO: 26240 - DNA, 21 bp, synthetic construct
  source 1..21: mol_type = other DNA
aacagtaagtaatttacacct

SEQ ID NO: 26241 - DNA, 21 bp, synthetic construct
  source 1..21: mol_type = other DNA
ggtgtaaattacttactgtta

SEQ ID NO: 26242 - DNA, 21 bp, synthetic construct
  source 1..21: mol_type = other DNA
ggtgtaaattacttactgtta

SEQ ID NO: 26243 - DNA, 21 bp, synthetic construct
  source 1..21: mol_type = other DNA
cagtaagtaatttacacctta

SEQ ID NO: 26244 - DNA, 20 bp, synthetic construct
  source 1..20: mol_type = other DNA
cgtaaggtgtaaattactta

SEQ ID NO: 26245 - DNA, 20 bp, synthetic construct
  source 1..20: mol_type = other DNA
taaggtgtaaattacttact

SEQ ID NO: 26246 - DNA, 20 bp, synthetic construct
  source 1..20: mol_type = other DNA
ttaacagtaagtaatttaca

SEQ ID NO: 26247 - DNA, 23 bp, synthetic construct
  source 1..23: mol_type = other DNA
gtggcctcgtaaggtgtaaatta

SEQ ID NO: 26248 - DNA, 21 bp, synthetic construct
  source 1..21: mol_type = other DNA
aacagtaagtaatttacacct

SEQ ID NO: 26249 - DNA, 21 bp, synthetic construct
  source 1..21: mol_type = other DNA
gtaaggtgtaaattacttact

SEQ ID NO: 26250 - DNA, 20 bp, synthetic construct
  source 1..20: mol_type = other DNA
taacagtaagtaatttacac

SEQ ID NO: 26251 - DNA, 20 bp, synthetic construct
  source 1..20: mol_type = other DNA
aaggtgtaaattacttactg

SEQ ID NO: 26252 - DNA, 21 bp, synthetic construct
  source 1..21: mol_type = other DNA
aacagtaagtaatttacacct

SEQ ID NO: 26253 - DNA, 20 bp, synthetic construct
  source 1..20: mol_type = other DNA
aacagtaagtaatttacacc

SEQ ID NO: 26254 - DNA, 20 bp, synthetic construct
  source 1..20: mol_type = other DNA
aggtgtaaattacttactgt

SEQ ID NO: 26255 - DNA, 20 bp, synthetic construct
  source 1..20: mol_type = other DNA
agtaagtaatttacacctta

SEQ ID NO: 26256 - DNA, 20 bp, synthetic construct
  source 1..20: mol_type = other DNA
acagtaagtaatttacacct

SEQ ID NO: 26257 - DNA, 20 bp, synthetic construct
  source 1..20: mol_type = other DNA
ggtgtaaattacttactgtt

SEQ ID NO: 26258 - DNA, 20 bp, synthetic construct
  source 1..20: mol_type = other DNA
cagtaagtaatttacacctt

SEQ ID NO: 26259 - DNA, 20 bp, synthetic construct
  source 1..20: mol_type = other DNA
taagtaatttacaccttacg

SEQ ID NO: 26260 - DNA, 20 bp, synthetic construct
  source 1..20: mol_type = other DNA
cagtaagtaatttacacctt

SEQ ID NO: 26261 - DNA, 20 bp, synthetic construct
  source 1..20: mol_type = other DNA
agtaagtaatttacacctta

SEQ ID NO: 26262 - DNA, 20 bp, synthetic construct
  source 1..20: mol_type = other DNA
gtgtaaattacttactgtta

SEQ ID NO: 26263 - DNA, 23 bp, synthetic construct
  source 1..23: mol_type = other DNA
acagtaagtaatttacaccttac

SEQ ID NO: 26264 - DNA, 23 bp, synthetic construct
  source 1..23: mol_type = other DNA
acagtaagtaatttacaccttac

SEQ ID NO: 26265 - DNA, 24 bp, synthetic construct
  source 1..24: mol_type = other DNA
aacagtaagtaatttacaccttac

SEQ ID NO: 26266 - DNA, 21 bp, synthetic construct
  source 1..21: mol_type = other DNA
agtaagtaatttacaccttac

SEQ ID NO: 26267 - DNA, 21 bp, synthetic construct
  source 1..21: mol_type = other DNA
cagtaagtaatttacacctta

SEQ ID NO: 26268 - DNA, 20 bp, synthetic construct
  source 1..20: mol_type = other DNA
gtaagtaatttacaccttac

SEQ ID NO: 26269 - DNA, 20 bp, synthetic construct
  source 1..20: mol_type = other DNA
taagtaatttacaccttacg

SEQ ID NO: 26270 - DNA, 20 bp, synthetic construct
  source 1..20: mol_type = other DNA
agtaagtaatttacacctta

SEQ ID NO: 26271 - DNA, 20 bp, synthetic construct
  source 1..20: mol_type = other DNA
agtaagtaatttacacctta

SEQ ID NO: 26272 - DNA, 20 bp, synthetic construct
  source 1..20: mol_type = other DNA
tgtaaattacttactgttaa

SEQ ID NO: 26273 - DNA, 23 bp, synthetic construct
  source 1..23: mol_type = other DNA
acagtaagtaatttacaccttac

SEQ ID NO: 26274 - DNA, 23 bp, synthetic construct
  source 1..23: mol_type = other DNA
acagtaagtaatttacaccttac

SEQ ID NO: 26275 - DNA, 23 bp, synthetic construct
  source 1..23: mol_type = other DNA
gtgtaaattacttactgttaatg

SEQ ID NO: 26276 - DNA, 23 bp, synthetic construct
  source 1..23: mol_type = other DNA
acagtaagtaatttacaccttac

SEQ ID NO: 26277 - DNA, 23 bp, synthetic construct
  source 1..23: mol_type = other DNA
gtgtaaattacttactgttaatg

SEQ ID NO: 26278 - DNA, 24 bp, synthetic construct
  source 1..24: mol_type = other DNA
gtaaattacttactgttaatggaa

SEQ ID NO: 26279 - DNA, 23 bp, synthetic construct
  source 1..23: mol_type = other DNA
taacagtaagtaatttacacctt

SEQ ID NO: 26280 - DNA, 21 bp, synthetic construct
  source 1..21: mol_type = other DNA
cagtaagtaatttacacctta

SEQ ID NO: 26281 - DNA, 21 bp, synthetic construct
  source 1..21: mol_type = other DNA
agtaagtaatttacaccttac

SEQ ID NO: 26282 - DNA, 21 bp, synthetic construct
  source 1..21: mol_type = other DNA
agtaagtaatttacaccttac

SEQ ID NO: 26283 - DNA, 20 bp, synthetic construct
  source 1..20: mol_type = other DNA
gtaagtaatttacaccttac

SEQ ID NO: 26284 - DNA, 20 bp, synthetic construct
  source 1..20: mol_type = other DNA
gtaagtaatttacaccttac

SEQ ID NO: 26285 - DNA, 20 bp, synthetic construct
  source 1..20: mol_type = other DNA
gtaaattacttactgttaat

SEQ ID NO: 26286 - DNA, 23 bp, synthetic construct
  source 1..23: mol_type = other DNA
gtgtaaattacttactgttaatg

SEQ ID NO: 26287 - DNA, 23 bp, synthetic construct
  source 1..23: mol_type = other DNA
gtgtaaattacttactgttaatg

SEQ ID NO: 26288 - DNA, 21 bp, synthetic construct
  source 1..21: mol_type = other DNA
cagtaagtaatttacacctta

SEQ ID NO: 26289 - DNA, 21 bp, synthetic construct
  source 1..21: mol_type = other DNA
agtaagtaatttacaccttac

SEQ ID NO: 26290 - DNA, 20 bp, synthetic construct
  source 1..20: mol_type = other DNA
taagtaatttacaccttacg

SEQ ID NO: 26291 - DNA, 20 bp, synthetic construct
  source 1..20: mol_type = other DNA
taaattacttactgttaatg

SEQ ID NO: 26292 - DNA, 21 bp, synthetic construct
  source 1..21: mol_type = other DNA
cagtaagtaatttacacctta

SEQ ID NO: 26293 - DNA, 20 bp, synthetic construct
  source 1..20: mol_type = other DNA
aagtaatttacaccttacga

SEQ ID NO: 26294 - DNA, 20 bp, synthetic construct
  source 1..20: mol_type = other DNA
aagtaatttacaccttacga

SEQ ID NO: 26295 - DNA, 20 bp, synthetic construct
  source 1..20: mol_type = other DNA
aaattacttactgttaatgg

SEQ ID NO: 26296 - DNA, 23 bp, synthetic construct
  source 1..23: mol_type = other DNA
taacagtaagtaatttacacctt

SEQ ID NO: 26297 - DNA, 21 bp, synthetic construct
  source 1..21: mol_type = other DNA
cagtaagtaatttacacctta

SEQ ID NO: 26298 - DNA, 21 bp, synthetic construct
  source 1..21: mol_type = other DNA
aaattacttactgttaatgga

SEQ ID NO: 26299 - DNA, 21 bp, synthetic construct
  source 1..21: mol_type = other DNA
aaattacttactgttaatgga

SEQ ID NO: 26300 - DNA, 20 bp, synthetic construct
  source 1..20: mol_type = other DNA
taagtaatttacaccttacg

SEQ ID NO: 26301 - DNA, 20 bp, synthetic construct
  source 1..20: mol_type = other DNA
agtaatttacaccttacgag

SEQ ID NO: 26302 - DNA, 20 bp, synthetic construct
  source 1..20: mol_type = other DNA
aattacttactgttaatgga

SEQ ID NO: 26303 - DNA, 21 bp, synthetic construct
  source 1..21: mol_type = other DNA
aatttacaccttacgaggcca

SEQ ID NO: 26304 - DNA, 21 bp, synthetic construct
  source 1..21: mol_type = other DNA
atttacaccttacgaggccac

SEQ ID NO: 26305 - DNA, 20 bp, synthetic construct
  source 1..20: mol_type = other DNA
aagtaatttacaccttacga

SEQ ID NO: 26306 - DNA, 20 bp, synthetic construct
  source 1..20: mol_type = other DNA
gtaatttacaccttacgagg

SEQ ID NO: 26307 - DNA, 20 bp, synthetic construct
  source 1..20: mol_type = other DNA
attacttactgttaatggaa

SEQ ID NO: 26308 - DNA, 23 bp, synthetic construct
  source 1..23: mol_type = other DNA
taacagtaagtaatttacacctt

SEQ ID NO: 26309 - DNA, 21 bp, synthetic construct
  source 1..21: mol_type = other DNA
aatttacaccttacgaggcca

SEQ ID NO: 26310 - DNA, 20 bp, synthetic construct
  source 1..20: mol_type = other DNA
tttacaccttacgaggccac

SEQ ID NO: 26311 - DNA, 20 bp, synthetic construct
  source 1..20: mol_type = other DNA
taatttacaccttacgaggc

SEQ ID NO: 26312 - DNA, 20 bp, synthetic construct
  source 1..20: mol_type = other DNA
ttacttactgttaatggaat

SEQ ID NO: 26313 - DNA, 23 bp, synthetic construct
  source 1..23: mol_type = other DNA
aaattacttactgttaatggaat

SEQ ID NO: 26314 - DNA, 23 bp, synthetic construct
  source 1..23: mol_type = other DNA
aaattacttactgttaatggaat

SEQ ID NO: 26315 - DNA, 21 bp, synthetic construct
  source 1..21: mol_type = other DNA
aatttacaccttacgaggcca

SEQ ID NO: 26316 - DNA, 20 bp, synthetic construct
  source 1..20: mol_type = other DNA
tacttactgttaatggaatc

SEQ ID NO: 26317 - DNA, 20 bp, synthetic construct
  source 1..20: mol_type = other DNA
tacttactgttaatggaatc

SEQ ID NO: 26318 - DNA, 20 bp, synthetic construct
  source 1..20: mol_type = other DNA
aatttacaccttacgaggcc

SEQ ID NO: 26319 - DNA, 20 bp, synthetic construct
  source 1..20: mol_type = other DNA
ttacttactgttaatggaat

SEQ ID NO: 26320 - DNA, 20 bp, synthetic construct
  source 1..20: mol_type = other DNA
acttactgttaatggaatca

SEQ ID NO: 26321 - DNA, 20 bp, synthetic construct
  source 1..20: mol_type = other DNA
atttacaccttacgaggcca

SEQ ID NO: 26322 - DNA, 23 bp, synthetic construct
  source 1..23: mol_type = other DNA
aaattacttactgttaatggaat

SEQ ID NO: 26323 - DNA, 24 bp, synthetic construct
  source 1..24: mol_type = other DNA
gtaaattacttactgttaatggaa

SEQ ID NO: 26324 - DNA, 20 bp, synthetic construct
  source 1..20: mol_type = other DNA
tttacaccttacgaggccac

SEQ ID NO: 26325 - DNA, 20 bp, synthetic construct
  source 1..20: mol_type = other DNA
cttactgttaatggaatcag

SEQ ID NO: 26326 - DNA, 23 bp, synthetic construct
  source 1..23: mol_type = other DNA
cttactgttaatggaatcagcca

SEQ ID NO: 26327 - DNA, 20 bp, synthetic construct
  source 1..20: mol_type = other DNA
ttacaccttacgaggccact

SEQ ID NO: 26328 - DNA, 20 bp, synthetic construct
  source 1..20: mol_type = other DNA
tacttactgttaatggaatc

SEQ ID NO: 26329 - DNA, 20 bp, synthetic construct
  source 1..20: mol_type = other DNA
ttacaccttacgaggccact

SEQ ID NO: 26330 - DNA, 20 bp, synthetic construct
  source 1..20: mol_type = other DNA
ttactgttaatggaatcagc

SEQ ID NO: 26331 - DNA, 23 bp, synthetic construct
  source 1..23: mol_type = other DNA
tttacaccttacgaggccactcg

SEQ ID NO: 26332 - DNA, 23 bp, synthetic construct
  source 1..23: mol_type = other DNA
tttacaccttacgaggccactcg

SEQ ID NO: 26333 - DNA, 23 bp, synthetic construct
  source 1..23: mol_type = other DNA
taacagtaagtaatttacacctt

SEQ ID NO: 26334 - DNA, 21 bp, synthetic construct
  source 1..21: mol_type = other DNA
aatttacaccttacgaggcca

SEQ ID NO: 26335 - DNA, 20 bp, synthetic construct
  source 1..20: mol_type = other DNA
ttacaccttacgaggccact

SEQ ID NO: 26336 - DNA, 20 bp, synthetic construct
  source 1..20: mol_type = other DNA
tacaccttacgaggccactc

SEQ ID NO: 26337 - DNA, 20 bp, synthetic construct
  source 1..20: mol_type = other DNA
ttacttactgttaatggaat

SEQ ID NO: 26338 - DNA, 20 bp, synthetic construct
  source 1..20: mol_type = other DNA
tactgttaatggaatcagcc

SEQ ID NO: 26339 - DNA, 21 bp, synthetic construct
  source 1..21: mol_type = other DNA
aatttacaccttacgaggcca

SEQ ID NO: 26340 - DNA, 20 bp, synthetic construct
  source 1..20: mol_type = other DNA
tacaccttacgaggccactc

SEQ ID NO: 26341 - DNA, 20 bp, synthetic construct
  source 1..20: mol_type = other DNA
acaccttacgaggccactcg

SEQ ID NO: 26342 - DNA, 20 bp, synthetic construct
  source 1..20: mol_type = other DNA
actgttaatggaatcagcca

SEQ ID NO: 26343 - DNA, 23 bp, synthetic construct
  source 1..23: mol_type = other DNA
cttactgttaatggaatcagcca

SEQ ID NO: 26344 - DNA, 20 bp, synthetic construct
  source 1..20: mol_type = other DNA
ttacaccttacgaggccact

SEQ ID NO: 26345 - DNA, 20 bp, synthetic construct
  source 1..20: mol_type = other DNA
caccttacgaggccactcgg

SEQ ID NO: 26346 - DNA, 20 bp, synthetic construct
  source 1..20: mol_type = other DNA
ctgttaatggaatcagccaa

SEQ ID NO: 26347 - DNA, 21 bp, synthetic construct
  source 1..21: mol_type = other DNA
cttacgaggccactcggtttc

SEQ ID NO: 26348 - DNA, 20 bp, synthetic construct
  source 1..20: mol_type = other DNA
accttacgaggccactcggt

SEQ ID NO: 26349 - DNA, 20 bp, synthetic construct
  source 1..20: mol_type = other DNA
tgttaatggaatcagccaaa

SEQ ID NO: 26350 - DNA, 23 bp, synthetic construct
  source 1..23: mol_type = other DNA
tacaccttacgaggccactcggt

SEQ ID NO: 26351 - DNA, 23 bp, synthetic construct
  source 1..23: mol_type = other DNA
tacaccttacgaggccactcggt

SEQ ID NO: 26352 - DNA, 23 bp, synthetic construct
  source 1..23: mol_type = other DNA
tacaccttacgaggccactcggt

SEQ ID NO: 26353 - DNA, 21 bp, synthetic construct
  source 1..21: mol_type = other DNA
ccttacgaggccactcggttt

SEQ ID NO: 26354 - DNA, 20 bp, synthetic construct
  source 1..20: mol_type = other DNA
acgaggccactcggtttctc

SEQ ID NO: 26355 - DNA, 20 bp, synthetic construct
  source 1..20: mol_type = other DNA
ccttacgaggccactcggtt

SEQ ID NO: 26356 - DNA, 20 bp, synthetic construct
  source 1..20: mol_type = other DNA
gttaatggaatcagccaaaa

SEQ ID NO: 26357 - DNA, 20 bp, synthetic construct
  source 1..20: mol_type = other DNA
tacgaggccactcggtttct

SEQ ID NO: 26358 - DNA, 20 bp, synthetic construct
  source 1..20: mol_type = other DNA
cttacgaggccactcggttt

SEQ ID NO: 26359 - DNA, 20 bp, synthetic construct
  source 1..20: mol_type = other DNA
ttaatggaatcagccaaaat

SEQ ID NO: 26360 - DNA, 20 bp, synthetic construct
  source 1..20: mol_type = other DNA
tggaatcagccaaaatctta

SEQ ID NO: 26361 - DNA, 20 bp, synthetic construct
  source 1..20: mol_type = other DNA
taatggaatcagccaaaatc

SEQ ID NO: 26362 - DNA, 20 bp, synthetic construct
  source 1..20: mol_type = other DNA
ttacgaggccactcggtttc

SEQ ID NO: 26363 - DNA, 23 bp, synthetic construct
  source 1..23: mol_type = other DNA
gttaatggaatcagccaaaatct

SEQ ID NO: 26364 - DNA, 23 bp, synthetic construct
  source 1..23: mol_type = other DNA
gttaatggaatcagccaaaatct

SEQ ID NO: 26365 - DNA, 23 bp, synthetic construct
  source 1..23: mol_type = other DNA
gaatcagccaaaatcttaagctg

SEQ ID NO: 26366 - DNA, 21 bp, synthetic construct
  source 1..21: mol_type = other DNA
ttaatggaatcagccaaaatc

SEQ ID NO: 26367 - DNA, 20 bp, synthetic construct
  source 1..20: mol_type = other DNA
atggaatcagccaaaatctt

SEQ ID NO: 26368 - DNA, 20 bp, synthetic construct
  source 1..20: mol_type = other DNA
cagccaaaatcttaagctgc

SEQ ID NO: 26369 - DNA, 20 bp, synthetic construct
  source 1..20: mol_type = other DNA
aatggaatcagccaaaatct

SEQ ID NO: 26370 - DNA, 20 bp, synthetic construct
  source 1..20: mol_type = other DNA
acgaggccactcggtttctc

SEQ ID NO: 26371 - DNA, 20 bp, synthetic construct
  source 1..20: mol_type = other DNA
tggaatcagccaaaatctta

SEQ ID NO: 26372 - DNA, 20 bp, synthetic construct
  source 1..20: mol_type = other DNA
tacgaggccactcggtttct

SEQ ID NO: 26373 - DNA, 23 bp, synthetic construct
  source 1..23: mol_type = other DNA
gaatcagccaaaatcttaagctg

SEQ ID NO: 26374 - DNA, 21 bp, synthetic construct
  source 1..21: mol_type = other DNA
ttaatggaatcagccaaaatc

SEQ ID NO: 26375 - DNA, 21 bp, synthetic construct
  source 1..21: mol_type = other DNA
atcagccaaaatcttaagctg

SEQ ID NO: 26376 - DNA, 21 bp, synthetic construct
  source 1..21: mol_type = other DNA
taatggaatcagccaaaatct

SEQ ID NO: 26377 - DNA, 20 bp, synthetic construct
  source 1..20: mol_type = other DNA
tacgaggccactcggtttct

SEQ ID NO: 26378 - DNA, 20 bp, synthetic construct
  source 1..20: mol_type = other DNA
ttacaccttacgaggccact

SEQ ID NO: 26379 - DNA, 20 bp, synthetic construct
  source 1..20: mol_type = other DNA
acgaggccactcggtttctc

SEQ ID NO: 26380 - DNA, 20 bp, synthetic construct
  source 1..20: mol_type = other DNA
atggaatcagccaaaatctt

SEQ ID NO: 26381 - DNA, 20 bp, synthetic construct
  source 1..20: mol_type = other DNA
atggaatcagccaaaatctt

SEQ ID NO: 26382 - DNA, 20 bp, synthetic construct
  source 1..20: mol_type = other DNA
acgaggccactcggtttctc

SEQ ID NO: 26383 - DNA, 23 bp, synthetic construct
  source 1..23: mol_type = other DNA
tacgaggccactcggtttctcag

SEQ ID NO: 26384 - DNA, 23 bp, synthetic construct
  source 1..23: mol_type = other DNA
tacgaggccactcggtttctcag

SEQ ID NO: 26385 - DNA, 21 bp, synthetic construct
  source 1..21: mol_type = other DNA
ttaatggaatcagccaaaatc

SEQ ID NO: 26386 - DNA, 21 bp, synthetic construct
  source 1..21: mol_type = other DNA
atttacaccttacgaggccac

SEQ ID NO: 26387 - DNA, 21 bp, synthetic construct
  source 1..21: mol_type = other DNA
cttacgaggccactcggtttc

SEQ ID NO: 26388 - DNA, 21 bp, synthetic construct
  source 1..21: mol_type = other DNA
taatggaatcagccaaaatct

SEQ ID NO: 26389 - DNA, 20 bp, synthetic construct
  source 1..20: mol_type = other DNA
tacgaggccactcggtttct

SEQ ID NO: 26390 - DNA, 20 bp, synthetic construct
  source 1..20: mol_type = other DNA
ttacaccttacgaggccact

SEQ ID NO: 26391 - DNA, 20 bp, synthetic construct
  source 1..20: mol_type = other DNA
cgaggccactcggtttctca

SEQ ID NO: 26392 - DNA, 20 bp, synthetic construct
  source 1..20: mol_type = other DNA
acgaggccactcggtttctc

SEQ ID NO: 26393 - DNA, 20 bp, synthetic construct
  source 1..20: mol_type = other DNA
tggaatcagccaaaatctta

SEQ ID NO: 26394 - DNA, 20 bp, synthetic construct
  source 1..20: mol_type = other DNA
gtgtaaattacttactgtta

SEQ ID NO: 26395 - DNA, 23 bp, synthetic construct
  source 1..23: mol_type = other DNA
gaggccactcggtttctcagtaa

SEQ ID NO: 26396 - DNA, 21 bp, synthetic construct
  source 1..21: mol_type = other DNA
tacgaggccactcggtttctc

SEQ ID NO: 26397 - DNA, 23 bp, synthetic construct
  source 1..23: mol_type = other DNA
gaggccactcggtttctcagtaa

SEQ ID NO: 26398 - DNA, 21 bp, synthetic construct
  source 1..21: mol_type = other DNA
tacgaggccactcggtttctc

SEQ ID NO: 26399 - DNA, 21 bp, synthetic construct
  source 1..21: mol_type = other DNA
aatcagccaaaatcttaagct

SEQ ID NO: 26400 - DNA, 21 bp, synthetic construct
  source 1..21: mol_type = other DNA
atttacaccttacgaggccac

SEQ ID NO: 26401 - DNA, 21 bp, synthetic construct
  source 1..21: mol_type = other DNA
cttacgaggccactcggtttc

SEQ ID NO: 26402 - DNA, 20 bp, synthetic construct
  source 1..20: mol_type = other DNA
tacgaggccactcggtttct

SEQ ID NO: 26403 - DNA, 20 bp, synthetic construct
  source 1..20: mol_type = other DNA
gaggccactcggtttctcag

SEQ ID NO: 26404 - DNA, 20 bp, synthetic construct
  source 1..20: mol_type = other DNA
ggaatcagccaaaatcttaa

SEQ ID NO: 26405-26594 - skipped (190 entries)

SEQ ID NO: 26595 - DNA, 20 bp, synthetic construct
  source 1..20: mol_type = other DNA
agttctcagtggcattttac

SEQ ID NO: 26596 - DNA, 20 bp, synthetic construct
  source 1..20: mol_type = other DNA
ttcctaaaaaagaagtaaaa

SEQ ID NO: 26597 - DNA, 20 bp, synthetic construct
  source 1..20: mol_type = other DNA
cctaaaaaagaagtaaaatg

SEQ ID NO: 26598 - DNA, 20 bp, synthetic construct
  source 1..20: mol_type = other DNA
gttctcagtggcattttact

SEQ ID NO: 26599 - DNA, 24 bp, synthetic construct
  source 1..24: mol_type = other DNA
gaagaccctgctctagggaggtgt

SEQ ID NO: 26600 - DNA, 20 bp, synthetic construct
  source 1..20: mol_type = other DNA
aaaaaagaagtaaaatgcca

SEQ ID NO: 26601 - DNA, 20 bp, synthetic construct
  source 1..20: mol_type = other DNA
ttgaagaccctgctctaggg

SEQ ID NO: 26602 - DNA, 20 bp, synthetic construct
  source 1..20: mol_type = other DNA
ctaaaaaagaagtaaaatgc

SEQ ID NO: 26603 - DNA, 20 bp, synthetic construct
  source 1..20: mol_type = other DNA
tggcattttacttctttttt

SEQ ID NO: 26604 - DNA, 20 bp, synthetic construct
  source 1..20: mol_type = other DNA
aaaaagaagtaaaatgccac

SEQ ID NO: 26605 - DNA, 20 bp, synthetic construct
  source 1..20: mol_type = other DNA
ttctcagtggcattttactt

SEQ ID NO: 26606 - DNA, 23 bp, synthetic construct
  source 1..23: mol_type = other DNA
aagagagttctcagtggcatttt

SEQ ID NO: 26607 - DNA, 24 bp, synthetic construct
  source 1..24: mol_type = other DNA
ttttacttcttttttaggaacacg

SEQ ID NO: 26608 - DNA, 21 bp, synthetic construct
  source 1..21: mol_type = other DNA
cttaagactacctttctccaa

SEQ ID NO: 26609 - DNA, 21 bp, synthetic construct
  source 1..21: mol_type = other DNA
aaaaaagaagtaaaatgccac

SEQ ID NO: 26610 - DNA, 20 bp, synthetic construct
  source 1..20: mol_type = other DNA
gtggcattttacttcttttt

SEQ ID NO: 26611 - DNA, 20 bp, synthetic construct
  source 1..20: mol_type = other DNA
tggcattttacttctttttt

SEQ ID NO: 26612 - DNA, 20 bp, synthetic construct
  source 1..20: mol_type = other DNA
tctcagtggcattttacttc

SEQ ID NO: 26613 - DNA, 20 bp, synthetic construct
  source 1..20: mol_type = other DNA
aaaaaagaagtaaaatgcca

SEQ ID NO: 26614 - DNA, 20 bp, synthetic construct
  source 1..20: mol_type = other DNA
taaaaaagaagtaaaatgcc

SEQ ID NO: 26615 - DNA, 20 bp, synthetic construct
  source 1..20: mol_type = other DNA
tggcattttacttctttttt

SEQ ID NO: 26616 - DNA, 23 bp, synthetic construct
  source 1..23: mol_type = other DNA
aagagagttctcagtggcatttt

SEQ ID NO: 26617 - DNA, 23 bp, synthetic construct
  source 1..23: mol_type = other DNA
aagagagttctcagtggcatttt

SEQ ID NO: 26618 - DNA, 24 bp, synthetic construct
  source 1..24: mol_type = other DNA
ttttacttcttttttaggaacacg

SEQ ID NO: 26619 - DNA, 21 bp, synthetic construct
  source 1..21: mol_type = other DNA
taaaaaagaagtaaaatgcca

SEQ ID NO: 26620 - DNA, 21 bp, synthetic construct
  source 1..21: mol_type = other DNA
taaaaaagaagtaaaatgcca

SEQ ID NO: 26621 - DNA, 21 bp, synthetic construct
  source 1..21: mol_type = other DNA
agtggcattttacttcttttt

SEQ ID NO: 26622 - DNA, 21 bp, synthetic construct
  source 1..21: mol_type = other DNA
cagtggcattttacttctttt

SEQ ID NO: 26623 - DNA, 21 bp, synthetic construct
  source 1..21: mol_type = other DNA
aaaaaagaagtaaaatgccac

SEQ ID NO: 26624 - DNA, 20 bp, synthetic construct
  source 1..20: mol_type = other DNA
gtggcattttacttcttttt

SEQ ID NO: 26625 - DNA, 20 bp, synthetic construct
  source 1..20: mol_type = other DNA
ctcagtggcattttacttct

SEQ ID NO: 26626 - DNA, 20 bp, synthetic construct
  source 1..20: mol_type = other DNA
aaaaaagaagtaaaatgcca

SEQ ID NO: 26627 - DNA, 23 bp, synthetic construct
  source 1..23: mol_type = other DNA
agtggcattttacttctttttta

SEQ ID NO: 26628 - DNA, 21 bp, synthetic construct
  source 1..21: mol_type = other DNA
aaaaaagaagtaaaatgccac

SEQ ID NO: 26629 - DNA, 21 bp, synthetic construct
  source 1..21: mol_type = other DNA
tcagtggcattttacttcttt

SEQ ID NO: 26630 - DNA, 20 bp, synthetic construct
  source 1..20: mol_type = other DNA
aaaaagaagtaaaatgccac

SEQ ID NO: 26631 - DNA, 20 bp, synthetic construct
  source 1..20: mol_type = other DNA
tcagtggcattttacttctt

SEQ ID NO: 26632 - DNA, 21 bp, synthetic construct
  source 1..21: mol_type = other DNA
aaaaagaagtaaaatgccact

SEQ ID NO: 26633 - DNA, 20 bp, synthetic construct
  source 1..20: mol_type = other DNA
aaaagaagtaaaatgccact

SEQ ID NO: 26634 - DNA, 20 bp, synthetic construct
  source 1..20: mol_type = other DNA
cagtggcattttacttcttt

SEQ ID NO: 26635 - DNA, 20 bp, synthetic construct
  source 1..20: mol_type = other DNA
aaagaagtaaaatgccactg

SEQ ID NO: 26636 - DNA, 20 bp, synthetic construct
  source 1..20: mol_type = other DNA
aaagaagtaaaatgccactg

SEQ ID NO: 26637 - DNA, 20 bp, synthetic construct
  source 1..20: mol_type = other DNA
agtggcattttacttctttt

SEQ ID NO: 26638 - DNA, 20 bp, synthetic construct
  source 1..20: mol_type = other DNA
aaaagaagtaaaatgccact

SEQ ID NO: 26639 - DNA, 20 bp, synthetic construct
  source 1..20: mol_type = other DNA
taagactacctttctccaaa

SEQ ID NO: 26640 - DNA, 20 bp, synthetic construct
  source 1..20: mol_type = other DNA
aagaagtaaaatgccactga

SEQ ID NO: 26641 - DNA, 20 bp, synthetic construct
  source 1..20: mol_type = other DNA
aaagaagtaaaatgccactg

SEQ ID NO: 26642 - DNA, 20 bp, synthetic construct
  source 1..20: mol_type = other DNA
gtggcattttacttcttttt

SEQ ID NO: 26643 - DNA, 23 bp, synthetic construct
  source 1..23: mol_type = other DNA
aaaaaagaagtaaaatgccactg

SEQ ID NO: 26644 - DNA, 23 bp, synthetic construct
  source 1..23: mol_type = other DNA
aaaaaagaagtaaaatgccactg

SEQ ID NO: 26645 - DNA, 24 bp, synthetic construct
  source 1..24: mol_type = other DNA
tccgtgttcctaaaaaagaagtaa

SEQ ID NO: 26646 - DNA, 21 bp, synthetic construct
  source 1..21: mol_type = other DNA
cttaagactacctttctccaa

SEQ ID NO: 26647 - DNA, 21 bp, synthetic construct
  source 1..21: mol_type = other DNA
aaaaaagaagtaaaatgccac

SEQ ID NO: 26648 - DNA, 20 bp, synthetic construct
  source 1..20: mol_type = other DNA
aaaagaagtaaaatgccact

SEQ ID NO: 26649 - DNA, 20 bp, synthetic construct
  source 1..20: mol_type = other DNA
taagactacctttctccaaa

SEQ ID NO: 26650 - DNA, 20 bp, synthetic construct
  source 1..20: mol_type = other DNA
agaagtaaaatgccactgag

SEQ ID NO: 26651 - DNA, 20 bp, synthetic construct
  source 1..20: mol_type = other DNA
aaagaagtaaaatgccactg

SEQ ID NO: 26652 - DNA, 20 bp, synthetic construct
  source 1..20: mol_type = other DNA
tggcattttacttctttttt

SEQ ID NO: 26653 - DNA, 23 bp, synthetic construct
  source 1..23: mol_type = other DNA
aaaagaagtaaaatgccactgag

SEQ ID NO: 26654 - DNA, 23 bp, synthetic construct
  source 1..23: mol_type = other DNA
aaaagaagtaaaatgccactgag

SEQ ID NO: 26655 - DNA, 23 bp, synthetic construct
  source 1..23: mol_type = other DNA
agtggcattttacttctttttta

SEQ ID NO: 26656 - DNA, 23 bp, synthetic construct
  source 1..23: mol_type = other DNA
aaaagaagtaaaatgccactgag

SEQ ID NO: 26657 - DNA, 23 bp, synthetic construct
  source 1..23: mol_type = other DNA
agtggcattttacttctttttta

SEQ ID NO: 26658 - DNA, 24 bp, synthetic construct
  source 1..24: mol_type = other DNA
ttttacttcttttttaggaacacg

SEQ ID NO: 26659 - DNA, 23 bp, synthetic construct
  source 1..23: mol_type = other DNA
taaaaaagaagtaaaatgccact

SEQ ID NO: 26660 - DNA, 21 bp, synthetic construct
  source 1..21: mol_type = other DNA
aaaaagaagtaaaatgccact

SEQ ID NO: 26661 - DNA, 21 bp, synthetic construct
  source 1..21: mol_type = other DNA
cttaagactacctttctccaa

SEQ ID NO: 26662 - DNA, 21 bp, synthetic construct
  source 1..21: mol_type = other DNA
aaaaaagaagtaaaatgccac

SEQ ID NO: 26663 - DNA, 20 bp, synthetic construct
  source 1..20: mol_type = other DNA
aaaagaagtaaaatgccact

SEQ ID NO: 26664 - DNA, 20 bp, synthetic construct
  source 1..20: mol_type = other DNA
gaagtaaaatgccactgaga

SEQ ID NO: 26665 - DNA, 20 bp, synthetic construct
  source 1..20: mol_type = other DNA
ggcattttacttctttttta

SEQ ID NO: 26666 - DNA, 23 bp, synthetic construct
  source 1..23: mol_type = other DNA
agtggcattttacttctttttta

SEQ ID NO: 26667 - DNA, 23 bp, synthetic construct
  source 1..23: mol_type = other DNA
agtggcattttacttctttttta

SEQ ID NO: 26668 - DNA, 21 bp, synthetic construct
  source 1..21: mol_type = other DNA
taaaatgccactgagaactct

SEQ ID NO: 26669 - DNA, 21 bp, synthetic construct
  source 1..21: mol_type = other DNA
aaatgccactgagaactctct

SEQ ID NO: 26670 - DNA, 20 bp, synthetic construct
  source 1..20: mol_type = other DNA
aagtaaaatgccactgagaa

SEQ ID NO: 26671 - DNA, 20 bp, synthetic construct
  source 1..20: mol_type = other DNA
gcattttacttcttttttag

SEQ ID NO: 26672 - DNA, 21 bp, synthetic construct
  source 1..21: mol_type = other DNA
taaaatgccactgagaactct

SEQ ID NO: 26673 - DNA, 20 bp, synthetic construct
  source 1..20: mol_type = other DNA
aaagaagtaaaatgccactg

SEQ ID NO: 26674 - DNA, 20 bp, synthetic construct
  source 1..20: mol_type = other DNA
agtaaaatgccactgagaac

SEQ ID NO: 26675 - DNA, 20 bp, synthetic construct
  source 1..20: mol_type = other DNA
cattttacttcttttttagg

SEQ ID NO: 26676 - DNA, 23 bp, synthetic construct
  source 1..23: mol_type = other DNA
taaaaaagaagtaaaatgccact

SEQ ID NO: 26677 - DNA, 21 bp, synthetic construct
  source 1..21: mol_type = other DNA
taaaatgccactgagaactct

SEQ ID NO: 26678 - DNA, 21 bp, synthetic construct
  source 1..21: mol_type = other DNA
attttacttcttttttaggaa

SEQ ID NO: 26679 - DNA, 21 bp, synthetic construct
  source 1..21: mol_type = other DNA
attttacttcttttttaggaa

SEQ ID NO: 26680 - DNA, 20 bp, synthetic construct
  source 1..20: mol_type = other DNA
atgccactgagaactctctt

SEQ ID NO: 26681 - DNA, 20 bp, synthetic construct
  source 1..20: mol_type = other DNA
gtaaaatgccactgagaact

SEQ ID NO: 26682 - DNA, 20 bp, synthetic construct
  source 1..20: mol_type = other DNA
attttacttcttttttagga

SEQ ID NO: 26683 - DNA, 21 bp, synthetic construct
  source 1..21: mol_type = other DNA
taaaatgccactgagaactct

SEQ ID NO: 26684 - DNA, 21 bp, synthetic construct
  source 1..21: mol_type = other DNA
aaatgccactgagaactctct

SEQ ID NO: 26685 - DNA, 20 bp, synthetic construct
  source 1..20: mol_type = other DNA
tgccactgagaactctctta

SEQ ID NO: 26686 - DNA, 20 bp, synthetic construct
  source 1..20: mol_type = other DNA
taaaatgccactgagaactc

SEQ ID NO: 26687 - DNA, 20 bp, synthetic construct
  source 1..20: mol_type = other DNA
ttttacttcttttttaggaa

SEQ ID NO: 26688 - DNA, 23 bp, synthetic construct
  source 1..23: mol_type = other DNA
taaaaaagaagtaaaatgccact

SEQ ID NO: 26689 - DNA, 21 bp, synthetic construct
  source 1..21: mol_type = other DNA
taaaatgccactgagaactct

SEQ ID NO: 26690 - DNA, 20 bp, synthetic construct
  source 1..20: mol_type = other DNA
atgccactgagaactctctt

SEQ ID NO: 26691 - DNA, 20 bp, synthetic construct
  source 1..20: mol_type = other DNA
aaaatgccactgagaactct

SEQ ID NO: 26692 - DNA, 20 bp, synthetic construct
  source 1..20: mol_type = other DNA
tttacttcttttttaggaac

SEQ ID NO: 26693 - DNA, 23 bp, synthetic construct
  source 1..23: mol_type = other DNA
attttacttcttttttaggaaca

SEQ ID NO: 26694 - DNA, 23 bp, synthetic construct
  source 1..23: mol_type = other DNA
attttacttcttttttaggaaca

SEQ ID NO: 26695 - DNA, 21 bp, synthetic construct
  source 1..21: mol_type = other DNA
aaaatgccactgagaactctc

SEQ ID NO: 26696 - DNA, 20 bp, synthetic construct
  source 1..20: mol_type = other DNA
ttacttcttttttaggaaca

SEQ ID NO: 26697 - DNA, 20 bp, synthetic construct
  source 1..20: mol_type = other DNA
ttacttcttttttaggaaca

SEQ ID NO: 26698 - DNA, 20 bp, synthetic construct
  source 1..20: mol_type = other DNA
aaatgccactgagaactctc

SEQ ID NO: 26699 - DNA, 20 bp, synthetic construct
  source 1..20: mol_type = other DNA
ttacttcttttttaggaaca

SEQ ID NO: 26700 - DNA, 20 bp, synthetic construct
  source 1..20: mol_type = other DNA
tacttcttttttaggaacac

SEQ ID NO: 26701 - DNA, 20 bp, synthetic construct
  source 1..20: mol_type = other DNA
aatgccactgagaactctct

SEQ ID NO: 26702 - DNA, 23 bp, synthetic construct
  source 1..23: mol_type = other DNA
attttacttcttttttaggaaca

SEQ ID NO: 26703 - DNA, 24 bp, synthetic construct
  source 1..24: mol_type = other DNA
ttttacttcttttttaggaacacg

SEQ ID NO: 26704 - DNA, 20 bp, synthetic construct
  source 1..20: mol_type = other DNA
atgccactgagaactctctt

SEQ ID NO: 26705 - DNA, 20 bp, synthetic construct
  source 1..20: mol_type = other DNA
acttcttttttaggaacacg

SEQ ID NO: 26706 - DNA, 23 bp, synthetic construct
  source 1..23: mol_type = other DNA
tttacttcttttttaggaacacg

SEQ ID NO: 26707 - DNA, 20 bp, synthetic construct
  source 1..20: mol_type = other DNA
tgccactgagaactctctta

SEQ ID NO: 26708 - DNA, 20 bp, synthetic construct
  source 1..20: mol_type = other DNA
tacttcttttttaggaacac

SEQ ID NO: 26709 - DNA, 20 bp, synthetic construct
  source 1..20: mol_type = other DNA
tgccactgagaactctctta

SEQ ID NO: 26710 - DNA, 20 bp, synthetic construct
  source 1..20: mol_type = other DNA
cttcttttttaggaacacgg

SEQ ID NO: 26711 - DNA, 23 bp, synthetic construct
  source 1..23: mol_type = other DNA
aaaatgccactgagaactctctt

SEQ ID NO: 26712 - DNA, 23 bp, synthetic construct
  source 1..23: mol_type = other DNA
aaaatgccactgagaactctctt

SEQ ID NO: 26713 - DNA, 23 bp, synthetic construct
  source 1..23: mol_type = other DNA
taaaaaagaagtaaaatgccact

SEQ ID NO: 26714 - DNA, 21 bp, synthetic construct
  source 1..21: mol_type = other DNA
aaatgccactgagaactctct

SEQ ID NO: 26715 - DNA, 20 bp, synthetic construct
  source 1..20: mol_type = other DNA
atgccactgagaactctctt

SEQ ID NO: 26716 - DNA, 20 bp, synthetic construct
  source 1..20: mol_type = other DNA
gccactgagaactctcttaa

SEQ ID NO: 26717 - DNA, 20 bp, synthetic construct
  source 1..20: mol_type = other DNA
ttacttcttttttaggaaca

SEQ ID NO: 26718 - DNA, 20 bp, synthetic construct
  source 1..20: mol_type = other DNA
ttcttttttaggaacacgga

SEQ ID NO: 26719 - DNA, 21 bp, synthetic construct
  source 1..21: mol_type = other DNA
aaatgccactgagaactctct

SEQ ID NO: 26720 - DNA, 20 bp, synthetic construct
  source 1..20: mol_type = other DNA
tgccactgagaactctctta

SEQ ID NO: 26721 - DNA, 20 bp, synthetic construct
  source 1..20: mol_type = other DNA
ccactgagaactctcttaag

SEQ ID NO: 26722 - DNA, 20 bp, synthetic construct
  source 1..20: mol_type = other DNA
tcttttttaggaacacggac

SEQ ID NO: 26723 - DNA, 23 bp, synthetic construct
  source 1..23: mol_type = other DNA
acttcttttttaggaacacggac

SEQ ID NO: 26724 - DNA, 20 bp, synthetic construct
  source 1..20: mol_type = other DNA
atgccactgagaactctctt

SEQ ID NO: 26725 - DNA, 20 bp, synthetic construct
  source 1..20: mol_type = other DNA
cactgagaactctcttaaga

SEQ ID NO: 26726 - DNA, 20 bp, synthetic construct
  source 1..20: mol_type = other DNA
cttttttaggaacacggaca

SEQ ID NO: 26727 - DNA, 21 bp, synthetic construct
  source 1..21: mol_type = other DNA
aaatgccactgagaactctct

SEQ ID NO: 26728 - DNA, 20 bp, synthetic construct
  source 1..20: mol_type = other DNA
actgagaactctcttaagac

SEQ ID NO: 26729 - DNA, 20 bp, synthetic construct
  source 1..20: mol_type = other DNA
ttttttaggaacacggacac

SEQ ID NO: 26730 - DNA, 23 bp, synthetic construct
  source 1..23: mol_type = other DNA
tgccactgagaactctcttaaga

SEQ ID NO: 26731 - DNA, 23 bp, synthetic construct
  source 1..23: mol_type = other DNA
tgccactgagaactctcttaaga

SEQ ID NO: 26732 - DNA, 23 bp, synthetic construct
  source 1..23: mol_type = other DNA
tgccactgagaactctcttaaga

SEQ ID NO: 26733 - DNA, 21 bp, synthetic construct
  source 1..21: mol_type = other DNA
actctcttaagactacctttc

SEQ ID NO: 26734 - DNA, 20 bp, synthetic construct
  source 1..20: mol_type = other DNA
tgccactgagaactctctta

SEQ ID NO: 26735 - DNA, 20 bp, synthetic construct
  source 1..20: mol_type = other DNA
ctgagaactctcttaagact

SEQ ID NO: 26736 - DNA, 20 bp, synthetic construct
  source 1..20: mol_type = other DNA
tttttaggaacacggacacc

SEQ ID NO: 26737 - DNA, 20 bp, synthetic construct
  source 1..20: mol_type = other DNA
atgccactgagaactctctt

SEQ ID NO: 26738 - DNA, 20 bp, synthetic construct
  source 1..20: mol_type = other DNA
tgagaactctcttaagacta

SEQ ID NO: 26739 - DNA, 20 bp, synthetic construct
  source 1..20: mol_type = other DNA
ttttaggaacacggacacct

SEQ ID NO: 26740 - DNA, 20 bp, synthetic construct
  source 1..20: mol_type = other DNA
aggaacacggacacctccct

SEQ ID NO: 26741 - DNA, 20 bp, synthetic construct
  source 1..20: mol_type = other DNA
tttaggaacacggacacctc

SEQ ID NO: 26742 - DNA, 20 bp, synthetic construct
  source 1..20: mol_type = other DNA
gagaactctcttaagactac

SEQ ID NO: 26743 - DNA, 23 bp, synthetic construct
  source 1..23: mol_type = other DNA
ttcttttttaggaacacggacac

SEQ ID NO: 26744 - DNA, 23 bp, synthetic construct
  source 1..23: mol_type = other DNA
ttcttttttaggaacacggacac

SEQ ID NO: 26745 - DNA, 23 bp, synthetic construct
  source 1..23: mol_type = other DNA
ttttaggaacacggacacctccc

SEQ ID NO: 26746 - DNA, 21 bp, synthetic construct
  source 1..21: mol_type = other DNA
tttaggaacacggacacctcc

SEQ ID NO: 26747 - DNA, 20 bp, synthetic construct
  source 1..20: mol_type = other DNA
taggaacacggacacctccc

SEQ ID NO: 26748 - DNA, 20 bp, synthetic construct
  source 1..20: mol_type = other DNA
cacggacacctccctagagc

SEQ ID NO: 26749 - DNA, 20 bp, synthetic construct
  source 1..20: mol_type = other DNA
ttaggaacacggacacctcc

SEQ ID NO: 26750 - DNA, 20 bp, synthetic construct
  source 1..20: mol_type = other DNA
tgccactgagaactctctta

SEQ ID NO: 26751 - DNA, 20 bp, synthetic construct
  source 1..20: mol_type = other DNA
aggaacacggacacctccct

SEQ ID NO: 26752 - DNA, 20 bp, synthetic construct
  source 1..20: mol_type = other DNA
agaactctcttaagactacc

SEQ ID NO: 26753 - DNA, 23 bp, synthetic construct
  source 1..23: mol_type = other DNA
ttttaggaacacggacacctccc

SEQ ID NO: 26754 - DNA, 21 bp, synthetic construct
  source 1..21: mol_type = other DNA
ttaggaacacggacacctccc

SEQ ID NO: 26755 - DNA, 21 bp, synthetic construct
  source 1..21: mol_type = other DNA
aacacggacacctccctagag

SEQ ID NO: 26756 - DNA, 21 bp, synthetic construct
  source 1..21: mol_type = other DNA
taggaacacggacacctccct

SEQ ID NO: 26757 - DNA, 20 bp, synthetic construct
  source 1..20: mol_type = other DNA
ttaagactacctttctccaa

SEQ ID NO: 26758 - DNA, 20 bp, synthetic construct
  source 1..20: mol_type = other DNA
taagactacctttctccaaa

SEQ ID NO: 26759 - DNA, 20 bp, synthetic construct
  source 1..20: mol_type = other DNA
gaactctcttaagactacct

SEQ ID NO: 26760 - DNA, 20 bp, synthetic construct
  source 1..20: mol_type = other DNA
taggaacacggacacctccc

SEQ ID NO: 26761 - DNA, 20 bp, synthetic construct
  source 1..20: mol_type = other DNA
taggaacacggacacctccc

SEQ ID NO: 26762 - DNA, 20 bp, synthetic construct
  source 1..20: mol_type = other DNA
tgccactgagaactctctta

SEQ ID NO: 26763 - DNA, 23 bp, synthetic construct
  source 1..23: mol_type = other DNA
tgagaactctcttaagactacct

SEQ ID NO: 26764 - DNA, 23 bp, synthetic construct
  source 1..23: mol_type = other DNA
tgagaactctcttaagactacct

SEQ ID NO: 26765 - DNA, 21 bp, synthetic construct
  source 1..21: mol_type = other DNA
ttaggaacacggacacctccc

SEQ ID NO: 26766 - DNA, 21 bp, synthetic construct
  source 1..21: mol_type = other DNA
cttaagactacctttctccaa

SEQ ID NO: 26767 - DNA, 21 bp, synthetic construct
  source 1..21: mol_type = other DNA
cttaagactacctttctccaa

SEQ ID NO: 26768 - DNA, 21 bp, synthetic construct
  source 1..21: mol_type = other DNA
taggaacacggacacctccct

SEQ ID NO: 26769 - DNA, 20 bp, synthetic construct
  source 1..20: mol_type = other DNA
ttaagactacctttctccaa

SEQ ID NO: 26770 - DNA, 20 bp, synthetic construct
  source 1..20: mol_type = other DNA
taagactacctttctccaaa

SEQ ID NO: 26771 - DNA, 20 bp, synthetic construct
  source 1..20: mol_type = other DNA
aactctcttaagactacctt

SEQ ID NO: 26772 - DNA, 20 bp, synthetic construct
  source 1..20: mol_type = other DNA
taagactacctttctccaaa

SEQ ID NO: 26773 - DNA, 20 bp, synthetic construct
  source 1..20: mol_type = other DNA
aggaacacggacacctccct

SEQ ID NO: 26774 - DNA, 20 bp, synthetic construct
  source 1..20: mol_type = other DNA
agtggcattttacttctttt

SEQ ID NO: 26775 - DNA, 23 bp, synthetic construct
  source 1..23: mol_type = other DNA
taaaaaagaagtaaaatgccact

SEQ ID NO: 26776 - DNA, 21 bp, synthetic construct
  source 1..21: mol_type = other DNA
actctcttaagactacctttc

SEQ ID NO: 26777 - DNA, 23 bp, synthetic construct
  source 1..23: mol_type = other DNA
taaaaaagaagtaaaatgccact

SEQ ID NO: 26778 - DNA, 21 bp, synthetic construct
  source 1..21: mol_type = other DNA
actctcttaagactacctttc

SEQ ID NO: 26779 - DNA, 21 bp, synthetic construct
  source 1..21: mol_type = other DNA
ggaacacggacacctccctag

SEQ ID NO: 26780 - DNA, 21 bp, synthetic construct
  source 1..21: mol_type = other DNA
cttaagactacctttctccaa

SEQ ID NO: 26781 - DNA, 21 bp, synthetic construct
  source 1..21: mol_type = other DNA
cttaagactacctttctccaa

SEQ ID NO: 26782 - DNA, 20 bp, synthetic construct
  source 1..20: mol_type = other DNA
ttaagactacctttctccaa

SEQ ID NO: 26783 - DNA, 20 bp, synthetic construct
  source 1..20: mol_type = other DNA
actctcttaagactaccttt

SEQ ID NO: 26784 - DNA, 20 bp, synthetic construct
  source 1..20: mol_type = other DNA
ggaacacggacacctcccta

SEQ ID NO: 26785-26974 - skipped (190 entries)

SEQ ID NO: 26975 - DNA, 24 bp, synthetic construct
  source 1..24: mol_type = other DNA
gcagcaggaaaagatggcgctcat

SEQ ID NO: 26976 - DNA, 20 bp, synthetic construct
  source 1..20: mol_type = other DNA
aggaaaagatggcgctcatt

SEQ ID NO: 26977 - DNA, 23 bp, synthetic construct
  source 1..23: mol_type = other DNA
agcaggaaaagatggcgctcatt

SEQ ID NO: 26978 - DNA, 21 bp, synthetic construct
  source 1..21: mol_type = other DNA
agctaccagttgccaggcaca

SEQ ID NO: 26979 - DNA, 21 bp, synthetic construct
  source 1..21: mol_type = other DNA
gctaccagttgccaggcacaa

SEQ ID NO: 26980 - DNA, 20 bp, synthetic construct
  source 1..20: mol_type = other DNA
gttgccaggcacaatgagcg

SEQ ID NO: 26981 - DNA, 20 bp, synthetic construct
  source 1..20: mol_type = other DNA
ggaaaagatggcgctcattg

SEQ ID NO: 26982 - DNA, 21 bp, synthetic construct
  source 1..21: mol_type = other DNA
agctaccagttgccaggcaca

SEQ ID NO: 26983 - DNA, 20 bp, synthetic construct
  source 1..20: mol_type = other DNA
ggaaaagatggcgctcattg

SEQ ID NO: 26984 - DNA, 20 bp, synthetic construct
  source 1..20: mol_type = other DNA
cagttgccaggcacaatgag

SEQ ID NO: 26985 - DNA, 20 bp, synthetic construct
  source 1..20: mol_type = other DNA
gaaaagatggcgctcattgt

SEQ ID NO: 26986 - DNA, 20 bp, synthetic construct
  source 1..20: mol_type = other DNA
ttgccaggcacaatgagcgc

SEQ ID NO: 26987 - DNA, 23 bp, synthetic construct
  source 1..23: mol_type = other DNA
ccagctaccagttgccaggcaca

SEQ ID NO: 26988 - DNA, 21 bp, synthetic construct
  source 1..21: mol_type = other DNA
agctaccagttgccaggcaca

SEQ ID NO: 26989 - DNA, 20 bp, synthetic construct
  source 1..20: mol_type = other DNA
aaagatggcgctcattgtgc

SEQ ID NO: 26990 - DNA, 20 bp, synthetic construct
  source 1..20: mol_type = other DNA
aaaagatggcgctcattgtg

SEQ ID NO: 26991 - DNA, 20 bp, synthetic construct
  source 1..20: mol_type = other DNA
ccagttgccaggcacaatga

SEQ ID NO: 26992 - DNA, 20 bp, synthetic construct
  source 1..20: mol_type = other DNA
tcctccagctaccagttgcc

SEQ ID NO: 26993 - DNA, 20 bp, synthetic construct
  source 1..20: mol_type = other DNA
tgccaggcacaatgagcgcc

SEQ ID NO: 26994 - DNA, 20 bp, synthetic construct
  source 1..20: mol_type = other DNA
cagttgccaggcacaatgag

SEQ ID NO: 26995 - DNA, 23 bp, synthetic construct
  source 1..23: mol_type = other DNA
ggaaaagatggcgctcattgtgc

SEQ ID NO: 26996 - DNA, 23 bp, synthetic construct
  source 1..23: mol_type = other DNA
ccagctaccagttgccaggcaca

SEQ ID NO: 26997 - DNA, 21 bp, synthetic construct
  source 1..21: mol_type = other DNA
agctaccagttgccaggcaca

SEQ ID NO: 26998 - DNA, 21 bp, synthetic construct
  source 1..21: mol_type = other DNA
tgtcctccagctaccagttgc

SEQ ID NO: 26999 - DNA, 21 bp, synthetic construct
  source 1..21: mol_type = other DNA
gctaccagttgccaggcacaa

SEQ ID NO: 27000 - DNA, 21 bp, synthetic construct
  source 1..21: mol_type = other DNA
aaaagatggcgctcattgtgc

SEQ ID NO: 27001 - DNA, 20 bp, synthetic construct
  source 1..20: mol_type = other DNA
ccagttgccaggcacaatga

SEQ ID NO: 27002 - DNA, 20 bp, synthetic construct
  source 1..20: mol_type = other DNA
gccaggcacaatgagcgcca

SEQ ID NO: 27003 - DNA, 20 bp, synthetic construct
  source 1..20: mol_type = other DNA
aaagatggcgctcattgtgc

SEQ ID NO: 27004 - DNA, 21 bp, synthetic construct
  source 1..21: mol_type = other DNA
aagatggcgctcattgtgcct

SEQ ID NO: 27005 - DNA, 21 bp, synthetic construct
  source 1..21: mol_type = other DNA
atgagcgccatcttttcctgc

SEQ ID NO: 27006 - DNA, 21 bp, synthetic construct
  source 1..21: mol_type = other DNA
aagatggcgctcattgtgcct

SEQ ID NO: 27007 - DNA, 20 bp, synthetic construct
  source 1..20: mol_type = other DNA
ccaggcacaatgagcgccat

SEQ ID NO: 27008 - DNA, 20 bp, synthetic construct
  source 1..20: mol_type = other DNA
aagatggcgctcattgtgcc

SEQ ID NO: 27009 - DNA, 21 bp, synthetic construct
  source 1..21: mol_type = other DNA
aagatggcgctcattgtgcct

SEQ ID NO: 27010 - DNA, 20 bp, synthetic construct
  source 1..20: mol_type = other DNA
caggcacaatgagcgccatc

SEQ ID NO: 27011 - DNA, 20 bp, synthetic construct
  source 1..20: mol_type = other DNA
agatggcgctcattgtgcct

SEQ ID NO: 27012 - DNA, 20 bp, synthetic construct
  source 1..20: mol_type = other DNA
aggcacaatgagcgccatct

SEQ ID NO: 27013 - DNA, 20 bp, synthetic construct
  source 1..20: mol_type = other DNA
gatggcgctcattgtgcctg

SEQ ID NO: 27014 - DNA, 20 bp, synthetic construct
  source 1..20: mol_type = other DNA
caatgagcgccatcttttcc

SEQ ID NO: 27015 - DNA, 20 bp, synthetic construct
  source 1..20: mol_type = other DNA
ggcacaatgagcgccatctt

SEQ ID NO: 27016 - DNA, 20 bp, synthetic construct
  source 1..20: mol_type = other DNA
atggcgctcattgtgcctgg

SEQ ID NO: 27017 - DNA, 23 bp, synthetic construct
  source 1..23: mol_type = other DNA
aaagatggcgctcattgtgcctg

SEQ ID NO: 27018 - DNA, 23 bp, synthetic construct
  source 1..23: mol_type = other DNA
aaagatggcgctcattgtgcctg

SEQ ID NO: 27019 - DNA, 24 bp, synthetic construct
  source 1..24: mol_type = other DNA
gcagcaggaaaagatggcgctcat

SEQ ID NO: 27020 - DNA, 20 bp, synthetic construct
  source 1..20: mol_type = other DNA
acaatgagcgccatcttttc

SEQ ID NO: 27021 - DNA, 20 bp, synthetic construct
  source 1..20: mol_type = other DNA
gcacaatgagcgccatcttt

SEQ ID NO: 27022 - DNA, 20 bp, synthetic construct
  source 1..20: mol_type = other DNA
tggcgctcattgtgcctggc

SEQ ID NO: 27023 - DNA, 23 bp, synthetic construct
  source 1..23: mol_type = other DNA
aggcacaatgagcgccatctttt

SEQ ID NO: 27024 - DNA, 23 bp, synthetic construct
  source 1..23: mol_type = other DNA
aaagatggcgctcattgtgcctg

SEQ ID NO: 27025 - DNA, 23 bp, synthetic construct
  source 1..23: mol_type = other DNA
aaagatggcgctcattgtgcctg

SEQ ID NO: 27026 - DNA, 23 bp, synthetic construct
  source 1..23: mol_type = other DNA
aggcacaatgagcgccatctttt

SEQ ID NO: 27027 - DNA, 23 bp, synthetic construct
  source 1..23: mol_type = other DNA
aaagatggcgctcattgtgcctg

SEQ ID NO: 27028 - DNA, 21 bp, synthetic construct
  source 1..21: mol_type = other DNA
atgagcgccatcttttcctgc

SEQ ID NO: 27029 - DNA, 21 bp, synthetic construct
  source 1..21: mol_type = other DNA
gagcgccatcttttcctgctg

SEQ ID NO: 27030 - DNA, 20 bp, synthetic construct
  source 1..20: mol_type = other DNA
cacaatgagcgccatctttt

SEQ ID NO: 27031 - DNA, 20 bp, synthetic construct
  source 1..20: mol_type = other DNA
ggcgctcattgtgcctggca

SEQ ID NO: 27032 - DNA, 21 bp, synthetic construct
  source 1..21: mol_type = other DNA
atgagcgccatcttttcctgc

SEQ ID NO: 27033 - DNA, 20 bp, synthetic construct
  source 1..20: mol_type = other DNA
caatgagcgccatcttttcc

SEQ ID NO: 27034 - DNA, 20 bp, synthetic construct
  source 1..20: mol_type = other DNA
cgctcattgtgcctggcaac

SEQ ID NO: 27035 - DNA, 20 bp, synthetic construct
  source 1..20: mol_type = other DNA
acaatgagcgccatcttttc

SEQ ID NO: 27036 - DNA, 20 bp, synthetic construct
  source 1..20: mol_type = other DNA
gcgctcattgtgcctggcaa

SEQ ID NO: 27037 - DNA, 23 bp, synthetic construct
  source 1..23: mol_type = other DNA
tgagcgccatcttttcctgctgc

SEQ ID NO: 27038 - DNA, 21 bp, synthetic construct
  source 1..21: mol_type = other DNA
atgagcgccatcttttcctgc

SEQ ID NO: 27039 - DNA, 20 bp, synthetic construct
  source 1..20: mol_type = other DNA
acaatgagcgccatcttttc

SEQ ID NO: 27040 - DNA, 20 bp, synthetic construct
  source 1..20: mol_type = other DNA
cttttcctgctgcaagaatg

SEQ ID NO: 27041 - DNA, 20 bp, synthetic construct
  source 1..20: mol_type = other DNA
caatgagcgccatcttttcc

SEQ ID NO: 27042 - DNA, 20 bp, synthetic construct
  source 1..20: mol_type = other DNA
cgctcattgtgcctggcaac

SEQ ID NO: 27043 - DNA, 20 bp, synthetic construct
  source 1..20: mol_type = other DNA
cgctcattgtgcctggcaac

SEQ ID NO: 27044 - DNA, 20 bp, synthetic construct
  source 1..20: mol_type = other DNA
cgctcattgtgcctggcaac

SEQ ID NO: 27045 - DNA, 20 bp, synthetic construct
  source 1..20: mol_type = other DNA
caatgagcgccatcttttcc

SEQ ID NO: 27046 - DNA, 20 bp, synthetic construct
  source 1..20: mol_type = other DNA
cgctcattgtgcctggcaac

SEQ ID NO: 27047 - DNA, 23 bp, synthetic construct
  source 1..23: mol_type = other DNA
gcgctcattgtgcctggcaactg

SEQ ID NO: 27048 - DNA, 24 bp, synthetic construct
  source 1..24: mol_type = other DNA
gcagcaggaaaagatggcgctcat

SEQ ID NO: 27049 - DNA, 23 bp, synthetic construct
  source 1..23: mol_type = other DNA
tgagcgccatcttttcctgctgc

SEQ ID NO: 27050 - DNA, 21 bp, synthetic construct
  source 1..21: mol_type = other DNA
atgagcgccatcttttcctgc

SEQ ID NO: 27051 - DNA, 21 bp, synthetic construct
  source 1..21: mol_type = other DNA
atcttttcctgctgcaagaat

SEQ ID NO: 27052 - DNA, 21 bp, synthetic construct
  source 1..21: mol_type = other DNA
gagcgccatcttttcctgctg

SEQ ID NO: 27053 - DNA, 21 bp, synthetic construct
  source 1..21: mol_type = other DNA
ggcgctcattgtgcctggcaa

SEQ ID NO: 27054 - DNA, 21 bp, synthetic construct
  source 1..21: mol_type = other DNA
gctcattgtgcctggcaactg

SEQ ID NO: 27055 - DNA, 20 bp, synthetic construct
  source 1..20: mol_type = other DNA
atgagcgccatcttttcctg

SEQ ID NO: 27056 - DNA, 20 bp, synthetic construct
  source 1..20: mol_type = other DNA
aatgagcgccatcttttcct

SEQ ID NO: 27057 - DNA, 20 bp, synthetic construct
  source 1..20: mol_type = other DNA
cgctcattgtgcctggcaac

SEQ ID NO: 27058 - DNA, 20 bp, synthetic construct
  source 1..20: mol_type = other DNA
gctcattgtgcctggcaact

SEQ ID NO: 27059 - DNA, 23 bp, synthetic construct
  source 1..23: mol_type = other DNA
gcgctcattgtgcctggcaactg

SEQ ID NO: 27060 - DNA, 23 bp, synthetic construct
  source 1..23: mol_type = other DNA
gcgctcattgtgcctggcaactg

SEQ ID NO: 27061 - DNA, 21 bp, synthetic construct
  source 1..21: mol_type = other DNA
atgagcgccatcttttcctgc

SEQ ID NO: 27062 - DNA, 21 bp, synthetic construct
  source 1..21: mol_type = other DNA
cgctcattgtgcctggcaact

SEQ ID NO: 27063 - DNA, 20 bp, synthetic construct
  source 1..20: mol_type = other DNA
tgagcgccatcttttcctgc

SEQ ID NO: 27064 - DNA, 20 bp, synthetic construct
  source 1..20: mol_type = other DNA
atgagcgccatcttttcctg

SEQ ID NO: 27065 - DNA, 20 bp, synthetic construct
  source 1..20: mol_type = other DNA
ctcattgtgcctggcaactg

SEQ ID NO: 27066 - DNA, 20 bp, synthetic construct
  source 1..20: mol_type = other DNA
atgagcgccatcttttcctg

SEQ ID NO: 27067 - DNA, 20 bp, synthetic construct
  source 1..20: mol_type = other DNA
tgagcgccatcttttcctgc

SEQ ID NO: 27068 - DNA, 20 bp, synthetic construct
  source 1..20: mol_type = other DNA
tcattgtgcctggcaactgg

SEQ ID NO: 27069 - DNA, 21 bp, synthetic construct
  source 1..21: mol_type = other DNA
gagcgccatcttttcctgctg

SEQ ID NO: 27070 - DNA, 20 bp, synthetic construct
  source 1..20: mol_type = other DNA
cattgtgcctggcaactggt

SEQ ID NO: 27071 - DNA, 20 bp, synthetic construct
  source 1..20: mol_type = other DNA
cattgtgcctggcaactggt

SEQ ID NO: 27072 - DNA, 20 bp, synthetic construct
  source 1..20: mol_type = other DNA
gagcgccatcttttcctgct

SEQ ID NO: 27073 - DNA, 21 bp, synthetic construct
  source 1..21: mol_type = other DNA
gagcgccatcttttcctgctg

SEQ ID NO: 27074 - DNA, 21 bp, synthetic construct
  source 1..21: mol_type = other DNA
gagcgccatcttttcctgctg

SEQ ID NO: 27075 - DNA, 20 bp, synthetic construct
  source 1..20: mol_type = other DNA
ttgtgcctggcaactggtag

SEQ ID NO: 27076 - DNA, 20 bp, synthetic construct
  source 1..20: mol_type = other DNA
tgtgcctggcaactggtagc

SEQ ID NO: 27077 - DNA, 20 bp, synthetic construct
  source 1..20: mol_type = other DNA
attgtgcctggcaactggta

SEQ ID NO: 27078 - DNA, 20 bp, synthetic construct
  source 1..20: mol_type = other DNA
tgagcgccatcttttcctgc

SEQ ID NO: 27079 - DNA, 20 bp, synthetic construct
  source 1..20: mol_type = other DNA
cattgtgcctggcaactggt

SEQ ID NO: 27080 - DNA, 20 bp, synthetic construct
  source 1..20: mol_type = other DNA
agcgccatcttttcctgctg

SEQ ID NO: 27081 - DNA, 23 bp, synthetic construct
  source 1..23: mol_type = other DNA
gcgctcattgtgcctggcaactg

SEQ ID NO: 27082 - DNA, 23 bp, synthetic construct
  source 1..23: mol_type = other DNA
gcgctcattgtgcctggcaactg

SEQ ID NO: 27083 - DNA, 24 bp, synthetic construct
  source 1..24: mol_type = other DNA
gcagcaggaaaagatggcgctcat

SEQ ID NO: 27084 - DNA, 21 bp, synthetic construct
  source 1..21: mol_type = other DNA
attgtgcctggcaactggtag

SEQ ID NO: 27085 - DNA, 21 bp, synthetic construct
  source 1..21: mol_type = other DNA
attgtgcctggcaactggtag

SEQ ID NO: 27086 - DNA, 20 bp, synthetic construct
  source 1..20: mol_type = other DNA
gcgccatcttttcctgctgc

SEQ ID NO: 27087 - DNA, 20 bp, synthetic construct
  source 1..20: mol_type = other DNA
gcgccatcttttcctgctgc

SEQ ID NO: 27088 - DNA, 20 bp, synthetic construct
  source 1..20: mol_type = other DNA
ttgtgcctggcaactggtag

SEQ ID NO: 27089 - DNA, 20 bp, synthetic construct
  source 1..20: mol_type = other DNA
ttgtgcctggcaactggtag

SEQ ID NO: 27090 - DNA, 23 bp, synthetic construct
  source 1..23: mol_type = other DNA
gcgctcattgtgcctggcaactg

SEQ ID NO: 27091 - DNA, 23 bp, synthetic construct
  source 1..23: mol_type = other DNA
gcgctcattgtgcctggcaactg

SEQ ID NO: 27092 - DNA, 21 bp, synthetic construct
  source 1..21: mol_type = other DNA
ttgtgcctggcaactggtagc

SEQ ID NO: 27093 - DNA, 20 bp, synthetic construct
  source 1..20: mol_type = other DNA
cgccatcttttcctgctgca

SEQ ID NO: 27094 - DNA, 20 bp, synthetic construct
  source 1..20: mol_type = other DNA
tgtgcctggcaactggtagc

SEQ ID NO: 27095 - DNA, 20 bp, synthetic construct
  source 1..20: mol_type = other DNA
cgccatcttttcctgctgca

SEQ ID NO: 27096 - DNA, 20 bp, synthetic construct
  source 1..20: mol_type = other DNA
tgtgcctggcaactggtagc

SEQ ID NO: 27097 - DNA, 23 bp, synthetic construct
  source 1..23: mol_type = other DNA
cacaatgagcgccatcttttcct

SEQ ID NO: 27098 - DNA, 23 bp, synthetic construct
  source 1..23: mol_type = other DNA
cacaatgagcgccatcttttcct

SEQ ID NO: 27099 - DNA, 20 bp, synthetic construct
  source 1..20: mol_type = other DNA
gcgccatcttttcctgctgc

SEQ ID NO: 27100 - DNA, 20 bp, synthetic construct
  source 1..20: mol_type = other DNA
gccatcttttcctgctgcaa

SEQ ID NO: 27101 - DNA, 20 bp, synthetic construct
  source 1..20: mol_type = other DNA
tgtgcctggcaactggtagc

SEQ ID NO: 27102 - DNA, 20 bp, synthetic construct
  source 1..20: mol_type = other DNA
tgtgcctggcaactggtagc

SEQ ID NO: 27103 - DNA, 20 bp, synthetic construct
  source 1..20: mol_type = other DNA
gtgcctggcaactggtagct

SEQ ID NO: 27104 - DNA, 20 bp, synthetic construct
  source 1..20: mol_type = other DNA
gtgcctggcaactggtagct

SEQ ID NO: 27105 - DNA, 21 bp, synthetic construct
  source 1..21: mol_type = other DNA
gtgcctggcaactggtagctg

SEQ ID NO: 27106 - DNA, 21 bp, synthetic construct
  source 1..21: mol_type = other DNA
gtgcctggcaactggtagctg

SEQ ID NO: 27107 - DNA, 20 bp, synthetic construct
  source 1..20: mol_type = other DNA
tgcctggcaactggtagctg

SEQ ID NO: 27108 - DNA, 20 bp, synthetic construct
  source 1..20: mol_type = other DNA
gcctggcaactggtagctgg

SEQ ID NO: 27109 - DNA, 20 bp, synthetic construct
  source 1..20: mol_type = other DNA
tgcctggcaactggtagctg

SEQ ID NO: 27110 - DNA, 20 bp, synthetic construct
  source 1..20: mol_type = other DNA
cgccatcttttcctgctgca

SEQ ID NO: 27111 - DNA, 20 bp, synthetic construct
  source 1..20: mol_type = other DNA
gtgcctggcaactggtagct

SEQ ID NO: 27112 - DNA, 20 bp, synthetic construct
  source 1..20: mol_type = other DNA
ccatcttttcctgctgcaag

SEQ ID NO: 27113 - DNA, 23 bp, synthetic construct
  source 1..23: mol_type = other DNA
ttgtgcctggcaactggtagctg

SEQ ID NO: 27114 - DNA, 21 bp, synthetic construct
  source 1..21: mol_type = other DNA
gtgcctggcaactggtagctg

SEQ ID NO: 27115 - DNA, 23 bp, synthetic construct
  source 1..23: mol_type = other DNA
ttgtgcctggcaactggtagctg

SEQ ID NO: 27116 - DNA, 21 bp, synthetic construct
  source 1..21: mol_type = other DNA
gtgcctggcaactggtagctg

SEQ ID NO: 27117 - DNA, 21 bp, synthetic construct
  source 1..21: mol_type = other DNA
gtgcctggcaactggtagctg

SEQ ID NO: 27118 - DNA, 21 bp, synthetic construct
  source 1..21: mol_type = other DNA
gtgcctggcaactggtagctg

SEQ ID NO: 27119 - DNA, 20 bp, synthetic construct
  source 1..20: mol_type = other DNA
catcttttcctgctgcaaga

SEQ ID NO: 27120 - DNA, 20 bp, synthetic construct
  source 1..20: mol_type = other DNA
catcttttcctgctgcaaga

SEQ ID NO: 27121 - DNA, 20 bp, synthetic construct
  source 1..20: mol_type = other DNA
gcctggcaactggtagctgg

SEQ ID NO: 27122 - DNA, 20 bp, synthetic construct
  source 1..20: mol_type = other DNA
gcctggcaactggtagctgg

SEQ ID NO: 27123 - DNA, 21 bp, synthetic construct
  source 1..21: mol_type = other DNA
cctggcaactggtagctggag

SEQ ID NO: 27124 - DNA, 20 bp, synthetic construct
  source 1..20: mol_type = other DNA
atcttttcctgctgcaagaa

SEQ ID NO: 27125 - DNA, 20 bp, synthetic construct
  source 1..20: mol_type = other DNA
cctggcaactggtagctgga

SEQ ID NO: 27126 - DNA, 20 bp, synthetic construct
  source 1..20: mol_type = other DNA
tcttttcctgctgcaagaat

SEQ ID NO: 27127 - DNA, 20 bp, synthetic construct
  source 1..20: mol_type = other DNA
ctggcaactggtagctggag

SEQ ID NO: 27128 - DNA, 20 bp, synthetic construct
  source 1..20: mol_type = other DNA
cttttcctgctgcaagaatg

SEQ ID NO: 27129 - DNA, 20 bp, synthetic construct
  source 1..20: mol_type = other DNA
tggcaactggtagctggagg

SEQ ID NO: 27130 - DNA, 20 bp, synthetic construct
  source 1..20: mol_type = other DNA
ttttcctgctgcaagaatga

SEQ ID NO: 27131 - DNA, 20 bp, synthetic construct
  source 1..20: mol_type = other DNA
ttttcctgctgcaagaatga

SEQ ID NO: 27132 - DNA, 20 bp, synthetic construct
  source 1..20: mol_type = other DNA
ggcaactggtagctggagga

SEQ ID NO: 27133 - DNA, 23 bp, synthetic construct
  source 1..23: mol_type = other DNA
tcctgctgcaagaatgaggtttg

SEQ ID NO: 27134 - DNA, 23 bp, synthetic construct
  source 1..23: mol_type = other DNA
tcctgctgcaagaatgaggtttg

SEQ ID NO: 27135 - DNA, 20 bp, synthetic construct
  source 1..20: mol_type = other DNA
cttttcctgctgcaagaatg

SEQ ID NO: 27136 - DNA, 20 bp, synthetic construct
  source 1..20: mol_type = other DNA
tttcctgctgcaagaatgag

SEQ ID NO: 27137 - DNA, 20 bp, synthetic construct
  source 1..20: mol_type = other DNA
gcaactggtagctggaggac

SEQ ID NO: 27138 - DNA, 23 bp, synthetic construct
  source 1..23: mol_type = other DNA
ctggcaactggtagctggaggac

SEQ ID NO: 27139 - DNA, 23 bp, synthetic construct
  source 1..23: mol_type = other DNA
ctggcaactggtagctggaggac

SEQ ID NO: 27140 - DNA, 20 bp, synthetic construct
  source 1..20: mol_type = other DNA
ttcctgctgcaagaatgagg

SEQ ID NO: 27141 - DNA, 20 bp, synthetic construct
  source 1..20: mol_type = other DNA
caactggtagctggaggaca

SEQ ID NO: 27142 - DNA, 20 bp, synthetic construct
  source 1..20: mol_type = other DNA
cctgctgcaagaatgaggtt

SEQ ID NO: 27143 - DNA, 20 bp, synthetic construct
  source 1..20: mol_type = other DNA
gcaactggtagctggaggac

SEQ ID NO: 27144 - DNA, 20 bp, synthetic construct
  source 1..20: mol_type = other DNA
tcctgctgcaagaatgaggt

SEQ ID NO: 27145 - DNA, 20 bp, synthetic construct
  source 1..20: mol_type = other DNA
aactggtagctggaggacag

SEQ ID NO: 27146 - DNA, 20 bp, synthetic construct
  source 1..20: mol_type = other DNA
cctgctgcaagaatgaggtt

SEQ ID NO: 27147 - DNA, 20 bp, synthetic construct
  source 1..20: mol_type = other DNA
cctgctgcaagaatgaggtt

SEQ ID NO: 27148 - DNA, 20 bp, synthetic construct
  source 1..20: mol_type = other DNA
gtagctggaggacagtactc

SEQ ID NO: 27149 - DNA, 20 bp, synthetic construct
  source 1..20: mol_type = other DNA
tagctggaggacagtactca

SEQ ID NO: 27150 - DNA, 20 bp, synthetic construct
  source 1..20: mol_type = other DNA
actggtagctggaggacagt

SEQ ID NO: 27151 - DNA, 20 bp, synthetic construct
  source 1..20: mol_type = other DNA
gcaactggtagctggaggac

SEQ ID NO: 27152-27328 - skipped (177 entries)

SEQ ID NO: 27329 - DNA, 24 bp, synthetic construct
  source 1..24: mol_type = other DNA
aagaagaaagaaaactcaaagctc

SEQ ID NO: 27330 - DNA, 20 bp, synthetic construct
  source 1..20: mol_type = other DNA
aaaagaagaaagaaaactca

SEQ ID NO: 27331 - DNA, 23 bp, synthetic construct
  source 1..23: mol_type = other DNA
gatgaaaagaagaaagaaaactc

SEQ ID NO: 27332 - DNA, 21 bp, synthetic construct
  source 1..21: mol_type = other DNA
ctgactcagtggtgatgagct

SEQ ID NO: 27333 - DNA, 21 bp, synthetic construct
  source 1..21: mol_type = other DNA
tgactcagtggtgatgagctt

SEQ ID NO: 27334 - DNA, 20 bp, synthetic construct
  source 1..20: mol_type = other DNA
ggtgatgagctttgagtttt

SEQ ID NO: 27335 - DNA, 20 bp, synthetic construct
  source 1..20: mol_type = other DNA
aaagaagaaagaaaactcaa

SEQ ID NO: 27336 - DNA, 21 bp, synthetic construct
  source 1..21: mol_type = other DNA
ctgactcagtggtgatgagct

SEQ ID NO: 27337 - DNA, 20 bp, synthetic construct
  source 1..20: mol_type = other DNA
aaagaagaaagaaaactcaa

SEQ ID NO: 27338 - DNA, 20 bp, synthetic construct
  source 1..20: mol_type = other DNA
ctcagtggtgatgagctttg

SEQ ID NO: 27339 - DNA, 20 bp, synthetic construct
  source 1..20: mol_type = other DNA
aagaagaaagaaaactcaaa

SEQ ID NO: 27340 - DNA, 20 bp, synthetic construct
  source 1..20: mol_type = other DNA
gtgatgagctttgagttttc

SEQ ID NO: 27341 - DNA, 23 bp, synthetic construct
  source 1..23: mol_type = other DNA
ctctgactcagtggtgatgagct

SEQ ID NO: 27342 - DNA, 21 bp, synthetic construct
  source 1..21: mol_type = other DNA
ctgactcagtggtgatgagct

SEQ ID NO: 27343 - DNA, 20 bp, synthetic construct
  source 1..20: mol_type = other DNA
aaaagaagaaagaaaactca

SEQ ID NO: 27344 - DNA, 20 bp, synthetic construct
  source 1..20: mol_type = other DNA
agaagaaagaaaactcaaag

SEQ ID NO: 27345 - DNA, 20 bp, synthetic construct
  source 1..20: mol_type = other DNA
actcagtggtgatgagcttt

SEQ ID NO: 27346 - DNA, 20 bp, synthetic construct
  source 1..20: mol_type = other DNA
tcctagtgcctctgactcag

SEQ ID NO: 27347 - DNA, 20 bp, synthetic construct
  source 1..20: mol_type = other DNA
tgatgagctttgagttttct

SEQ ID NO: 27348 - DNA, 20 bp, synthetic construct
  source 1..20: mol_type = other DNA
ctcagtggtgatgagctttg

SEQ ID NO: 27349 - DNA, 23 bp, synthetic construct
  source 1..23: mol_type = other DNA
aaagaagaaagaaaactcaaagc

SEQ ID NO: 27350 - DNA, 23 bp, synthetic construct
  source 1..23: mol_type = other DNA
ctctgactcagtggtgatgagct

SEQ ID NO: 27351 - DNA, 21 bp, synthetic construct
  source 1..21: mol_type = other DNA
agttttctttcttcttttcat

SEQ ID NO: 27352 - DNA, 21 bp, synthetic construct
  source 1..21: mol_type = other DNA
ttcttttcatcccagcttgca

SEQ ID NO: 27353 - DNA, 21 bp, synthetic construct
  source 1..21: mol_type = other DNA
tgactcagtggtgatgagctt

SEQ ID NO: 27354 - DNA, 21 bp, synthetic construct
  source 1..21: mol_type = other DNA
tgaaaagaagaaagaaaactc

SEQ ID NO: 27355 - DNA, 20 bp, synthetic construct
  source 1..20: mol_type = other DNA
actcagtggtgatgagcttt

SEQ ID NO: 27356 - DNA, 20 bp, synthetic construct
  source 1..20: mol_type = other DNA
gatgagctttgagttttctt

SEQ ID NO: 27357 - DNA, 20 bp, synthetic construct
  source 1..20: mol_type = other DNA
gaagaaagaaaactcaaagc

SEQ ID NO: 27358 - DNA, 21 bp, synthetic construct
  source 1..21: mol_type = other DNA
gaaaactcaaagctcatcacc

SEQ ID NO: 27359 - DNA, 21 bp, synthetic construct
  source 1..21: mol_type = other DNA
agttttctttcttcttttcat

SEQ ID NO: 27360 - DNA, 21 bp, synthetic construct
  source 1..21: mol_type = other DNA
gaaaactcaaagctcatcacc

SEQ ID NO: 27361 - DNA, 20 bp, synthetic construct
  source 1..20: mol_type = other DNA
atgagctttgagttttcttt

SEQ ID NO: 27362 - DNA, 20 bp, synthetic construct
  source 1..20: mol_type = other DNA
aagaaagaaaactcaaagct

SEQ ID NO: 27363 - DNA, 21 bp, synthetic construct
  source 1..21: mol_type = other DNA
gaaaactcaaagctcatcacc

SEQ ID NO: 27364 - DNA, 20 bp, synthetic construct
  source 1..20: mol_type = other DNA
tgagctttgagttttctttc

SEQ ID NO: 27365 - DNA, 20 bp, synthetic construct
  source 1..20: mol_type = other DNA
agaaagaaaactcaaagctc

SEQ ID NO: 27366 - DNA, 20 bp, synthetic construct
  source 1..20: mol_type = other DNA
gagctttgagttttctttct

SEQ ID NO: 27367 - DNA, 20 bp, synthetic construct
  source 1..20: mol_type = other DNA
gaaagaaaactcaaagctca

SEQ ID NO: 27368 - DNA, 20 bp, synthetic construct
  source 1..20: mol_type = other DNA
ttctttcttcttttcatccc

SEQ ID NO: 27369 - DNA, 20 bp, synthetic construct
  source 1..20: mol_type = other DNA
agctttgagttttctttctt

SEQ ID NO: 27370 - DNA, 20 bp, synthetic construct
  source 1..20: mol_type = other DNA
aaagaaaactcaaagctcat

SEQ ID NO: 27371 - DNA, 23 bp, synthetic construct
  source 1..23: mol_type = other DNA
gaagaaagaaaactcaaagctca

SEQ ID NO: 27372 - DNA, 23 bp, synthetic construct
  source 1..23: mol_type = other DNA
gaagaaagaaaactcaaagctca

SEQ ID NO: 27373 - DNA, 24 bp, synthetic construct
  source 1..24: mol_type = other DNA
aagaagaaagaaaactcaaagctc

SEQ ID NO: 27374 - DNA, 20 bp, synthetic construct
  source 1..20: mol_type = other DNA
tttctttcttcttttcatcc

SEQ ID NO: 27375 - DNA, 20 bp, synthetic construct
  source 1..20: mol_type = other DNA
gctttgagttttctttcttc

SEQ ID NO: 27376 - DNA, 20 bp, synthetic construct
  source 1..20: mol_type = other DNA
aagaaaactcaaagctcatc

SEQ ID NO: 27377 - DNA, 23 bp, synthetic construct
  source 1..23: mol_type = other DNA
tgagctttgagttttctttcttc

SEQ ID NO: 27378 - DNA, 23 bp, synthetic construct
  source 1..23: mol_type = other DNA
agaaagaaaactcaaagctcatc

SEQ ID NO: 27379 - DNA, 23 bp, synthetic construct
  source 1..23: mol_type = other DNA
agaaagaaaactcaaagctcatc

SEQ ID NO: 27380 - DNA, 23 bp, synthetic construct
  source 1..23: mol_type = other DNA
tgagctttgagttttctttcttc

SEQ ID NO: 27381 - DNA, 23 bp, synthetic construct
  source 1..23: mol_type = other DNA
agaaagaaaactcaaagctcatc

SEQ ID NO: 27382 - DNA, 21 bp, synthetic construct
  source 1..21: mol_type = other DNA
agttttctttcttcttttcat

SEQ ID NO: 27383 - DNA, 21 bp, synthetic construct
  source 1..21: mol_type = other DNA
gttttctttcttcttttcatc

SEQ ID NO: 27384 - DNA, 20 bp, synthetic construct
  source 1..20: mol_type = other DNA
ctttgagttttctttcttct

SEQ ID NO: 27385 - DNA, 20 bp, synthetic construct
  source 1..20: mol_type = other DNA
agaaaactcaaagctcatca

SEQ ID NO: 27386 - DNA, 21 bp, synthetic construct
  source 1..21: mol_type = other DNA
agttttctttcttcttttcat

SEQ ID NO: 27387 - DNA, 20 bp, synthetic construct
  source 1..20: mol_type = other DNA
ttctttcttcttttcatccc

SEQ ID NO: 27388 - DNA, 20 bp, synthetic construct
  source 1..20: mol_type = other DNA
aactcaaagctcatcaccac

SEQ ID NO: 27389 - DNA, 20 bp, synthetic construct
  source 1..20: mol_type = other DNA
tttgagttttctttcttctt

SEQ ID NO: 27390 - DNA, 20 bp, synthetic construct
  source 1..20: mol_type = other DNA
gaaaactcaaagctcatcac

SEQ ID NO: 27391 - DNA, 23 bp, synthetic construct
  source 1..23: mol_type = other DNA
ctctgactcagtggtgatgagct

SEQ ID NO: 27392 - DNA, 21 bp, synthetic construct
  source 1..21: mol_type = other DNA
agttttctttcttcttttcat

SEQ ID NO: 27393 - DNA, 20 bp, synthetic construct
  source 1..20: mol_type = other DNA
tttctttcttcttttcatcc

SEQ ID NO: 27394 - DNA, 20 bp, synthetic construct
  source 1..20: mol_type = other DNA
cttttcatcccagcttgcac

SEQ ID NO: 27395 - DNA, 20 bp, synthetic construct
  source 1..20: mol_type = other DNA
ttgagttttctttcttcttt

SEQ ID NO: 27396 - DNA, 20 bp, synthetic construct
  source 1..20: mol_type = other DNA
aaactcaaagctcatcacca

SEQ ID NO: 27397 - DNA, 20 bp, synthetic construct
  source 1..20: mol_type = other DNA
gctcatcaccactgagtcag

SEQ ID NO: 27398 - DNA, 20 bp, synthetic construct
  source 1..20: mol_type = other DNA
aaaactcaaagctcatcacc

SEQ ID NO: 27399 - DNA, 20 bp, synthetic construct
  source 1..20: mol_type = other DNA
ttctttcttcttttcatccc

SEQ ID NO: 27400 - DNA, 20 bp, synthetic construct
  source 1..20: mol_type = other DNA
aactcaaagctcatcaccac

SEQ ID NO: 27401 - DNA, 23 bp, synthetic construct
  source 1..23: mol_type = other DNA
aaaactcaaagctcatcaccact

SEQ ID NO: 27402 - DNA, 24 bp, synthetic construct
  source 1..24: mol_type = other DNA
aagaagaaagaaaactcaaagctc

SEQ ID NO: 27403 - DNA, 23 bp, synthetic construct
  source 1..23: mol_type = other DNA
ctctgactcagtggtgatgagct

SEQ ID NO: 27404 - DNA, 21 bp, synthetic construct
  source 1..21: mol_type = other DNA
agttttctttcttcttttcat

SEQ ID NO: 27405 - DNA, 21 bp, synthetic construct
  source 1..21: mol_type = other DNA
ttcttttcatcccagcttgca

SEQ ID NO: 27406 - DNA, 21 bp, synthetic construct
  source 1..21: mol_type = other DNA
gttttctttcttcttttcatc

SEQ ID NO: 27407 - DNA, 21 bp, synthetic construct
  source 1..21: mol_type = other DNA
aagctcatcaccactgagtca

SEQ ID NO: 27408 - DNA, 21 bp, synthetic construct
  source 1..21: mol_type = other DNA
aaactcaaagctcatcaccac

SEQ ID NO: 27409 - DNA, 20 bp, synthetic construct
  source 1..20: mol_type = other DNA
tttctttcttcttttcatcc

SEQ ID NO: 27410 - DNA, 20 bp, synthetic construct
  source 1..20: mol_type = other DNA
tgagttttctttcttctttt

SEQ ID NO: 27411 - DNA, 20 bp, synthetic construct
  source 1..20: mol_type = other DNA
aaactcaaagctcatcacca

SEQ ID NO: 27412 - DNA, 20 bp, synthetic construct
  source 1..20: mol_type = other DNA
aaactcaaagctcatcacca

SEQ ID NO: 27413 - DNA, 23 bp, synthetic construct
  source 1..23: mol_type = other DNA
aaaactcaaagctcatcaccact

SEQ ID NO: 27414 - DNA, 23 bp, synthetic construct
  source 1..23: mol_type = other DNA
aaaactcaaagctcatcaccact

SEQ ID NO: 27415 - DNA, 21 bp, synthetic construct
  source 1..21: mol_type = other DNA
agttttctttcttcttttcat

SEQ ID NO: 27416 - DNA, 21 bp, synthetic construct
  source 1..21: mol_type = other DNA
aaaactcaaagctcatcacca

SEQ ID NO: 27417 - DNA, 20 bp, synthetic construct
  source 1..20: mol_type = other DNA
ttctttcttcttttcatccc

SEQ ID NO: 27418 - DNA, 20 bp, synthetic construct
  source 1..20: mol_type = other DNA
gagttttctttcttcttttc

SEQ ID NO: 27419 - DNA, 20 bp, synthetic construct
  source 1..20: mol_type = other DNA
aactcaaagctcatcaccac

SEQ ID NO: 27420 - DNA, 20 bp, synthetic construct
  source 1..20: mol_type = other DNA
tttctttcttcttttcatcc

SEQ ID NO: 27421 - DNA, 20 bp, synthetic construct
  source 1..20: mol_type = other DNA
agttttctttcttcttttca

SEQ ID NO: 27422 - DNA, 20 bp, synthetic construct
  source 1..20: mol_type = other DNA
actcaaagctcatcaccact

SEQ ID NO: 27423 - DNA, 21 bp, synthetic construct
  source 1..21: mol_type = other DNA
gttttctttcttcttttcatc

SEQ ID NO: 27424 - DNA, 20 bp, synthetic construct
  source 1..20: mol_type = other DNA
ctcaaagctcatcaccactg

SEQ ID NO: 27425 - DNA, 20 bp, synthetic construct
  source 1..20: mol_type = other DNA
ctcaaagctcatcaccactg

SEQ ID NO: 27426 - DNA, 20 bp, synthetic construct
  source 1..20: mol_type = other DNA
gttttctttcttcttttcat

SEQ ID NO: 27427 - DNA, 21 bp, synthetic construct
  source 1..21: mol_type = other DNA
agttttctttcttcttttcat

SEQ ID NO: 27428 - DNA, 21 bp, synthetic construct
  source 1..21: mol_type = other DNA
agttttctttcttcttttcat

SEQ ID NO: 27429 - DNA, 20 bp, synthetic construct
  source 1..20: mol_type = other DNA
actcaaagctcatcaccact

SEQ ID NO: 27430 - DNA, 20 bp, synthetic construct
  source 1..20: mol_type = other DNA
gctcatcaccactgagtcag

SEQ ID NO: 27431 - DNA, 20 bp, synthetic construct
  source 1..20: mol_type = other DNA
tcaaagctcatcaccactga

SEQ ID NO: 27432 - DNA, 20 bp, synthetic construct
  source 1..20: mol_type = other DNA
ttctttcttcttttcatccc

SEQ ID NO: 27433 - DNA, 20 bp, synthetic construct
  source 1..20: mol_type = other DNA
ctcaaagctcatcaccactg

SEQ ID NO: 27434 - DNA, 20 bp, synthetic construct
  source 1..20: mol_type = other DNA
ttttctttcttcttttcatc

SEQ ID NO: 27435 - DNA, 23 bp, synthetic construct
  source 1..23: mol_type = other DNA
aaaactcaaagctcatcaccact

SEQ ID NO: 27436 - DNA, 23 bp, synthetic construct
  source 1..23: mol_type = other DNA
aaaactcaaagctcatcaccact

SEQ ID NO: 27437 - DNA, 24 bp, synthetic construct
  source 1..24: mol_type = other DNA
aagaagaaagaaaactcaaagctc

SEQ ID NO: 27438 - DNA, 21 bp, synthetic construct
  source 1..21: mol_type = other DNA
aagctcatcaccactgagtca

SEQ ID NO: 27439 - DNA, 21 bp, synthetic construct
  source 1..21: mol_type = other DNA
tcaaagctcatcaccactgag

SEQ ID NO: 27440 - DNA, 20 bp, synthetic construct
  source 1..20: mol_type = other DNA
tttctttcttcttttcatcc

SEQ ID NO: 27441 - DNA, 20 bp, synthetic construct
  source 1..20: mol_type = other DNA
tttctttcttcttttcatcc

SEQ ID NO: 27442 - DNA, 20 bp, synthetic construct
  source 1..20: mol_type = other DNA
aaagctcatcaccactgagt

SEQ ID NO: 27443 - DNA, 20 bp, synthetic construct
  source 1..20: mol_type = other DNA
caaagctcatcaccactgag

SEQ ID NO: 27444 - DNA, 23 bp, synthetic construct
  source 1..23: mol_type = other DNA
aaaactcaaagctcatcaccact

SEQ ID NO: 27445 - DNA, 23 bp, synthetic construct
  source 1..23: mol_type = other DNA
aaaactcaaagctcatcaccact

SEQ ID NO: 27446 - DNA, 21 bp, synthetic construct
  source 1..21: mol_type = other DNA
caaagctcatcaccactgagt

SEQ ID NO: 27447 - DNA, 20 bp, synthetic construct
  source 1..20: mol_type = other DNA
ttctttcttcttttcatccc

SEQ ID NO: 27448 - DNA, 20 bp, synthetic construct
  source 1..20: mol_type = other DNA
aagctcatcaccactgagtc

SEQ ID NO: 27449 - DNA, 20 bp, synthetic construct
  source 1..20: mol_type = other DNA
ttctttcttcttttcatccc

SEQ ID NO: 27450 - DNA, 20 bp, synthetic construct
  source 1..20: mol_type = other DNA
aaagctcatcaccactgagt

SEQ ID NO: 27451 - DNA, 23 bp, synthetic construct
  source 1..23: mol_type = other DNA
gagttttctttcttcttttcatc

SEQ ID NO: 27452 - DNA, 23 bp, synthetic construct
  source 1..23: mol_type = other DNA
gagttttctttcttcttttcatc

SEQ ID NO: 27453 - DNA, 20 bp, synthetic construct
  source 1..20: mol_type = other DNA
tttctttcttcttttcatcc

SEQ ID NO: 27454 - DNA, 20 bp, synthetic construct
  source 1..20: mol_type = other DNA
tctttcttcttttcatccca

SEQ ID NO: 27455 - DNA, 20 bp, synthetic construct
  source 1..20: mol_type = other DNA
agctcatcaccactgagtca

SEQ ID NO: 27456 - DNA, 20 bp, synthetic construct
  source 1..20: mol_type = other DNA
gctcatcaccactgagtcag

SEQ ID NO: 27457 - DNA, 20 bp, synthetic construct
  source 1..20: mol_type = other DNA
aagctcatcaccactgagtc

SEQ ID NO: 27458 - DNA, 20 bp, synthetic construct
  source 1..20: mol_type = other DNA
aagctcatcaccactgagtc

SEQ ID NO: 27459 - DNA, 21 bp, synthetic construct
  source 1..21: mol_type = other DNA
aagctcatcaccactgagtca

SEQ ID NO: 27460 - DNA, 21 bp, synthetic construct
  source 1..21: mol_type = other DNA
aagctcatcaccactgagtca

SEQ ID NO: 27461 - DNA, 20 bp, synthetic construct
  source 1..20: mol_type = other DNA
agctcatcaccactgagtca

SEQ ID NO: 27462 - DNA, 20 bp, synthetic construct
  source 1..20: mol_type = other DNA
gctcatcaccactgagtcag

SEQ ID NO: 27463 - DNA, 20 bp, synthetic construct
  source 1..20: mol_type = other DNA
agctcatcaccactgagtca

SEQ ID NO: 27464 - DNA, 20 bp, synthetic construct
  source 1..20: mol_type = other DNA
ttctttcttcttttcatccc

SEQ ID NO: 27465 - DNA, 20 bp, synthetic construct
  source 1..20: mol_type = other DNA
aagctcatcaccactgagtc

SEQ ID NO: 27466 - DNA, 20 bp, synthetic construct
  source 1..20: mol_type = other DNA
ctttcttcttttcatcccag

SEQ ID NO: 27467 - DNA, 23 bp, synthetic construct
  source 1..23: mol_type = other DNA
ctcaaagctcatcaccactgagt

SEQ ID NO: 27468 - DNA, 21 bp, synthetic construct
  source 1..21: mol_type = other DNA
aaagctcatcaccactgagtc

SEQ ID NO: 27469 - DNA, 23 bp, synthetic construct
  source 1..23: mol_type = other DNA
ctcaaagctcatcaccactgagt

SEQ ID NO: 27470 - DNA, 21 bp, synthetic construct
  source 1..21: mol_type = other DNA
aaagctcatcaccactgagtc

SEQ ID NO: 27471 - DNA, 21 bp, synthetic construct
  source 1..21: mol_type = other DNA
aagctcatcaccactgagtca

SEQ ID NO: 27472 - DNA, 21 bp, synthetic construct
  source 1..21: mol_type = other DNA
aagctcatcaccactgagtca

SEQ ID NO: 27473 - DNA, 20 bp, synthetic construct
  source 1..20: mol_type = other DNA
tttcttcttttcatcccagc

SEQ ID NO: 27474 - DNA, 20 bp, synthetic construct
  source 1..20: mol_type = other DNA
tttcttcttttcatcccagc

SEQ ID NO: 27475 - DNA, 20 bp, synthetic construct
  source 1..20: mol_type = other DNA
gctcatcaccactgagtcag

SEQ ID NO: 27476 - DNA, 20 bp, synthetic construct
  source 1..20: mol_type = other DNA
gctcatcaccactgagtcag

SEQ ID NO: 27477 - DNA, 21 bp, synthetic construct
  source 1..21: mol_type = other DNA
catcaccactgagtcagaggc

SEQ ID NO: 27478 - DNA, 20 bp, synthetic construct
  source 1..20: mol_type = other DNA
ttcttcttttcatcccagct

SEQ ID NO: 27479 - DNA, 20 bp, synthetic construct
  source 1..20: mol_type = other DNA
ctcatcaccactgagtcaga

SEQ ID NO: 27480 - DNA, 20 bp, synthetic construct
  source 1..20: mol_type = other DNA
tcttcttttcatcccagctt

SEQ ID NO: 27481 - DNA, 20 bp, synthetic construct
  source 1..20: mol_type = other DNA
tcatcaccactgagtcagag

SEQ ID NO: 27482 - DNA, 20 bp, synthetic construct
  source 1..20: mol_type = other DNA
cttcttttcatcccagcttg

SEQ ID NO: 27483 - DNA, 20 bp, synthetic construct
  source 1..20: mol_type = other DNA
catcaccactgagtcagagg

SEQ ID NO: 27484 - DNA, 20 bp, synthetic construct
  source 1..20: mol_type = other DNA
cttttcatcccagcttgcac

SEQ ID NO: 27485 - DNA, 20 bp, synthetic construct
  source 1..20: mol_type = other DNA
ttcttttcatcccagcttgc

SEQ ID NO: 27486 - DNA, 20 bp, synthetic construct
  source 1..20: mol_type = other DNA
atcaccactgagtcagaggc

SEQ ID NO: 27487 - DNA, 23 bp, synthetic construct
  source 1..23: mol_type = other DNA
tctttcttcttttcatcccagct

SEQ ID NO: 27488 - DNA, 23 bp, synthetic construct
  source 1..23: mol_type = other DNA
tctttcttcttttcatcccagct

SEQ ID NO: 27489 - DNA, 20 bp, synthetic construct
  source 1..20: mol_type = other DNA
tcttttcatcccagcttgca

SEQ ID NO: 27490 - DNA, 20 bp, synthetic construct
  source 1..20: mol_type = other DNA
tcttttcatcccagcttgca

SEQ ID NO: 27491 - DNA, 20 bp, synthetic construct
  source 1..20: mol_type = other DNA
tcaccactgagtcagaggca

SEQ ID NO: 27492 - DNA, 23 bp, synthetic construct
  source 1..23: mol_type = other DNA
caccactgagtcagaggcactag

SEQ ID NO: 27493 - DNA, 23 bp, synthetic construct
  source 1..23: mol_type = other DNA
caccactgagtcagaggcactag

SEQ ID NO: 27494 - DNA, 20 bp, synthetic construct
  source 1..20: mol_type = other DNA
cttttcatcccagcttgcac

SEQ ID NO: 27495 - DNA, 20 bp, synthetic construct
  source 1..20: mol_type = other DNA
caccactgagtcagaggcac

SEQ ID NO: 27496 - DNA, 20 bp, synthetic construct
  source 1..20: mol_type = other DNA
ttttcatcccagcttgcact

SEQ ID NO: 27497 - DNA, 20 bp, synthetic construct
  source 1..20: mol_type = other DNA
accactgagtcagaggcact

SEQ ID NO: 27498 - DNA, 20 bp, synthetic construct
  source 1..20: mol_type = other DNA
ttttcatcccagcttgcact

SEQ ID NO: 27499 - DNA, 20 bp, synthetic construct
  source 1..20: mol_type = other DNA
accactgagtcagaggcact

SEQ ID NO: 27500 - DNA, 20 bp, synthetic construct
  source 1..20: mol_type = other DNA
cttttcatcccagcttgcac

SEQ ID NO: 27501 - DNA, 20 bp, synthetic construct
  source 1..20: mol_type = other DNA
tttcatcccagcttgcactg

SEQ ID NO: 27502 - DNA, 20 bp, synthetic construct
  source 1..20: mol_type = other DNA
accactgagtcagaggcact

SEQ ID NO: 27503 - DNA, 20 bp, synthetic construct
  source 1..20: mol_type = other DNA
accactgagtcagaggcact

SEQ ID NO: 27504 - DNA, 20 bp, synthetic construct
  source 1..20: mol_type = other DNA
ccactgagtcagaggcacta

SEQ ID NO: 27505 - DNA, 20 bp, synthetic construct
  source 1..20: mol_type = other DNA
ccactgagtcagaggcacta

SEQ ID NO: 27506-27682 - skipped (177 entries)

SEQ ID NO: 27683 - DNA, 20 bp, synthetic construct
  source 1..20: mol_type = other DNA
cacggttcgggggtatacat

SEQ ID NO: 27684 - DNA, 20 bp, synthetic construct
  source 1..20: mol_type = other DNA
acggttcgggggtatacatg

SEQ ID NO: 27685 - DNA, 21 bp, synthetic construct
  source 1..21: mol_type = other DNA
actgcacacagtacatcagac

SEQ ID NO: 27686 - DNA, 21 bp, synthetic construct
  source 1..21: mol_type = other DNA
cccatgtatacccccgaaccg

SEQ ID NO: 27687 - DNA, 20 bp, synthetic construct
  source 1..20: mol_type = other DNA
atccaagcccatgtataccc

SEQ ID NO: 27688 - DNA, 20 bp, synthetic construct
  source 1..20: mol_type = other DNA
tggatccaagcccatgtata

SEQ ID NO: 27689 - DNA, 20 bp, synthetic construct
  source 1..20: mol_type = other DNA
cggttcgggggtatacatgg

SEQ ID NO: 27690 - DNA, 23 bp, synthetic construct
  source 1..23: mol_type = other DNA
acatggatccaagcccatgtata

SEQ ID NO: 27691 - DNA, 23 bp, synthetic construct
  source 1..23: mol_type = other DNA
acatggatccaagcccatgtata

SEQ ID NO: 27692 - DNA, 21 bp, synthetic construct
  source 1..21: mol_type = other DNA
ggatccaagcccatgtatacc

SEQ ID NO: 27693 - DNA, 21 bp, synthetic construct
  source 1..21: mol_type = other DNA
cccatgtatacccccgaaccg

SEQ ID NO: 27694 - DNA, 20 bp, synthetic construct
  source 1..20: mol_type = other DNA
tccaagcccatgtatacccc

SEQ ID NO: 27695 - DNA, 20 bp, synthetic construct
  source 1..20: mol_type = other DNA
ggatccaagcccatgtatac

SEQ ID NO: 27696 - DNA, 20 bp, synthetic construct
  source 1..20: mol_type = other DNA
ggttcgggggtatacatggg

SEQ ID NO: 27697 - DNA, 23 bp, synthetic construct
  source 1..23: mol_type = other DNA
tggatccaagcccatgtataccc

SEQ ID NO: 27698 - DNA, 21 bp, synthetic construct
  source 1..21: mol_type = other DNA
ggatccaagcccatgtatacc

SEQ ID NO: 27699 - DNA, 20 bp, synthetic construct
  source 1..20: mol_type = other DNA
atccaagcccatgtataccc

SEQ ID NO: 27700 - DNA, 20 bp, synthetic construct
  source 1..20: mol_type = other DNA
tgcacacagtacatcagaca

SEQ ID NO: 27701 - DNA, 20 bp, synthetic construct
  source 1..20: mol_type = other DNA
gatccaagcccatgtatacc

SEQ ID NO: 27702 - DNA, 20 bp, synthetic construct
  source 1..20: mol_type = other DNA
tccaagcccatgtatacccc

SEQ ID NO: 27703 - DNA, 20 bp, synthetic construct
  source 1..20: mol_type = other DNA
gttcgggggtatacatgggc

SEQ ID NO: 27704 - DNA, 23 bp, synthetic construct
  source 1..23: mol_type = other DNA
tggatccaagcccatgtataccc

SEQ ID NO: 27705 - DNA, 21 bp, synthetic construct
  source 1..21: mol_type = other DNA
gatccaagcccatgtataccc

SEQ ID NO: 27706 - DNA, 21 bp, synthetic construct
  source 1..21: mol_type = other DNA
actgcacacagtacatcagac

SEQ ID NO: 27707 - DNA, 21 bp, synthetic construct
  source 1..21: mol_type = other DNA
cccatgtatacccccgaaccg

SEQ ID NO: 27708 - DNA, 20 bp, synthetic construct
  source 1..20: mol_type = other DNA
atccaagcccatgtataccc

SEQ ID NO: 27709 - DNA, 20 bp, synthetic construct
  source 1..20: mol_type = other DNA
atccaagcccatgtataccc

SEQ ID NO: 27710 - DNA, 20 bp, synthetic construct
  source 1..20: mol_type = other DNA
ttcgggggtatacatgggct

SEQ ID NO: 27711 - DNA, 23 bp, synthetic construct
  source 1..23: mol_type = other DNA
ggttcgggggtatacatgggctt

SEQ ID NO: 27712 - DNA, 23 bp, synthetic construct
  source 1..23: mol_type = other DNA
ggttcgggggtatacatgggctt

SEQ ID NO: 27713 - DNA, 24 bp, synthetic construct
  source 1..24: mol_type = other DNA
cggttcgggggtatacatgggctt

SEQ ID NO: 27714 - DNA, 21 bp, synthetic construct
  source 1..21: mol_type = other DNA
gatccaagcccatgtataccc

SEQ ID NO: 27715 - DNA, 20 bp, synthetic construct
  source 1..20: mol_type = other DNA
tccaagcccatgtatacccc

SEQ ID NO: 27716 - DNA, 20 bp, synthetic construct
  source 1..20: mol_type = other DNA
tcgggggtatacatgggctt

SEQ ID NO: 27717 - DNA, 23 bp, synthetic construct
  source 1..23: mol_type = other DNA
ggttcgggggtatacatgggctt

SEQ ID NO: 27718 - DNA, 23 bp, synthetic construct
  source 1..23: mol_type = other DNA
ggttcgggggtatacatgggctt

SEQ ID NO: 27719 - DNA, 21 bp, synthetic construct
  source 1..21: mol_type = other DNA
ggttcgggggtatacatgggc

SEQ ID NO: 27720 - DNA, 20 bp, synthetic construct
  source 1..20: mol_type = other DNA
tccaagcccatgtatacccc

SEQ ID NO: 27721 - DNA, 20 bp, synthetic construct
  source 1..20: mol_type = other DNA
ccaagcccatgtataccccc

SEQ ID NO: 27722 - DNA, 20 bp, synthetic construct
  source 1..20: mol_type = other DNA
cgggggtatacatgggcttg

SEQ ID NO: 27723 - DNA, 20 bp, synthetic construct
  source 1..20: mol_type = other DNA
agcccatgtatacccccgaa

SEQ ID NO: 27724 - DNA, 20 bp, synthetic construct
  source 1..20: mol_type = other DNA
tgcacacagtacatcagaca

SEQ ID NO: 27725 - DNA, 20 bp, synthetic construct
  source 1..20: mol_type = other DNA
caagcccatgtatacccccg

SEQ ID NO: 27726 - DNA, 20 bp, synthetic construct
  source 1..20: mol_type = other DNA
tccaagcccatgtatacccc

SEQ ID NO: 27727 - DNA, 20 bp, synthetic construct
  source 1..20: mol_type = other DNA
gggggtatacatgggcttgg

SEQ ID NO: 27728 - DNA, 21 bp, synthetic construct
  source 1..21: mol_type = other DNA
actgcacacagtacatcagac

SEQ ID NO: 27729 - DNA, 21 bp, synthetic construct
  source 1..21: mol_type = other DNA
cccatgtatacccccgaaccg

SEQ ID NO: 27730 - DNA, 20 bp, synthetic construct
  source 1..20: mol_type = other DNA
agcccatgtatacccccgaa

SEQ ID NO: 27731 - DNA, 20 bp, synthetic construct
  source 1..20: mol_type = other DNA
aagcccatgtatacccccga

SEQ ID NO: 27732 - DNA, 20 bp, synthetic construct
  source 1..20: mol_type = other DNA
ggggtatacatgggcttgga

SEQ ID NO: 27733 - DNA, 23 bp, synthetic construct
  source 1..23: mol_type = other DNA
gttcgggggtatacatgggcttg

SEQ ID NO: 27734 - DNA, 24 bp, synthetic construct
  source 1..24: mol_type = other DNA
cggttcgggggtatacatgggctt

SEQ ID NO: 27735 - DNA, 24 bp, synthetic construct
  source 1..24: mol_type = other DNA
aaccgtgagtactgtcctccagct

SEQ ID NO: 27736 - DNA, 21 bp, synthetic construct
  source 1..21: mol_type = other DNA
agcccatgtatacccccgaac

SEQ ID NO: 27737 - DNA, 21 bp, synthetic construct
  source 1..21: mol_type = other DNA
agcccatgtatacccccgaac

SEQ ID NO: 27738 - DNA, 21 bp, synthetic construct
  source 1..21: mol_type = other DNA
cccatgtatacccccgaaccg

SEQ ID NO: 27739 - DNA, 20 bp, synthetic construct
  source 1..20: mol_type = other DNA
agcccatgtatacccccgaa

SEQ ID NO: 27740 - DNA, 20 bp, synthetic construct
  source 1..20: mol_type = other DNA
gggtatacatgggcttggat

SEQ ID NO: 27741 - DNA, 23 bp, synthetic construct
  source 1..23: mol_type = other DNA
ggggtatacatgggcttggatcc

SEQ ID NO: 27742 - DNA, 23 bp, synthetic construct
  source 1..23: mol_type = other DNA
ggggtatacatgggcttggatcc

SEQ ID NO: 27743 - DNA, 23 bp, synthetic construct
  source 1..23: mol_type = other DNA
ggggtatacatgggcttggatcc

SEQ ID NO: 27744 - DNA, 21 bp, synthetic construct
  source 1..21: mol_type = other DNA
agcccatgtatacccccgaac

SEQ ID NO: 27745 - DNA, 20 bp, synthetic construct
  source 1..20: mol_type = other DNA
tatacatgggcttggatcca

SEQ ID NO: 27746 - DNA, 20 bp, synthetic construct
  source 1..20: mol_type = other DNA
gcccatgtatacccccgaac

SEQ ID NO: 27747 - DNA, 20 bp, synthetic construct
  source 1..20: mol_type = other DNA
ggtatacatgggcttggatc

SEQ ID NO: 27748 - DNA, 20 bp, synthetic construct
  source 1..20: mol_type = other DNA
gtatacatgggcttggatcc

SEQ ID NO: 27749 - DNA, 20 bp, synthetic construct
  source 1..20: mol_type = other DNA
gtatacatgggcttggatcc

SEQ ID NO: 27750 - DNA, 20 bp, synthetic construct
  source 1..20: mol_type = other DNA
cccatgtatacccccgaacc

SEQ ID NO: 27751 - DNA, 23 bp, synthetic construct
  source 1..23: mol_type = other DNA
ggggtatacatgggcttggatcc

SEQ ID NO: 27752 - DNA, 24 bp, synthetic construct
  source 1..24: mol_type = other DNA
cggttcgggggtatacatgggctt

SEQ ID NO: 27753 - DNA, 20 bp, synthetic construct
  source 1..20: mol_type = other DNA
ccatgtatacccccgaaccg

SEQ ID NO: 27754 - DNA, 20 bp, synthetic construct
  source 1..20: mol_type = other DNA
tatacatgggcttggatcca

SEQ ID NO: 27755 - DNA, 23 bp, synthetic construct
  source 1..23: mol_type = other DNA
cccatgtatacccccgaaccgtg

SEQ ID NO: 27756 - DNA, 23 bp, synthetic construct
  source 1..23: mol_type = other DNA
cccatgtatacccccgaaccgtg

SEQ ID NO: 27757 - DNA, 23 bp, synthetic construct
  source 1..23: mol_type = other DNA
ggggtatacatgggcttggatcc

SEQ ID NO: 27758 - DNA, 20 bp, synthetic construct
  source 1..20: mol_type = other DNA
atgtatacccccgaaccgtg

SEQ ID NO: 27759 - DNA, 20 bp, synthetic construct
  source 1..20: mol_type = other DNA
catgtatacccccgaaccgt

SEQ ID NO: 27760 - DNA, 20 bp, synthetic construct
  source 1..20: mol_type = other DNA
atacatgggcttggatccat

SEQ ID NO: 27761 - DNA, 20 bp, synthetic construct
  source 1..20: mol_type = other DNA
catgtatacccccgaaccgt

SEQ ID NO: 27762 - DNA, 20 bp, synthetic construct
  source 1..20: mol_type = other DNA
atgtatacccccgaaccgtg

SEQ ID NO: 27763 - DNA, 20 bp, synthetic construct
  source 1..20: mol_type = other DNA
tacatgggcttggatccatg

SEQ ID NO: 27764 - DNA, 23 bp, synthetic construct
  source 1..23: mol_type = other DNA
cccatgtatacccccgaaccgtg

SEQ ID NO: 27765 - DNA, 23 bp, synthetic construct
  source 1..23: mol_type = other DNA
ggggtatacatgggcttggatcc

SEQ ID NO: 27766 - DNA, 24 bp, synthetic construct
  source 1..24: mol_type = other DNA
atgtatacccccgaaccgtgagta

SEQ ID NO: 27767 - DNA, 24 bp, synthetic construct
  source 1..24: mol_type = other DNA
cggttcgggggtatacatgggctt

SEQ ID NO: 27768 - DNA, 21 bp, synthetic construct
  source 1..21: mol_type = other DNA
cccatgtatacccccgaaccg

SEQ ID NO: 27769 - DNA, 20 bp, synthetic construct
  source 1..20: mol_type = other DNA
tgtatacccccgaaccgtga

SEQ ID NO: 27770 - DNA, 20 bp, synthetic construct
  source 1..20: mol_type = other DNA
acatgggcttggatccatgt

SEQ ID NO: 27771 - DNA, 23 bp, synthetic construct
  source 1..23: mol_type = other DNA
cccatgtatacccccgaaccgtg

SEQ ID NO: 27772 - DNA, 23 bp, synthetic construct
  source 1..23: mol_type = other DNA
catgggcttggatccatgtctga

SEQ ID NO: 27773 - DNA, 21 bp, synthetic construct
  source 1..21: mol_type = other DNA
gcccatgtatacccccgaacc

SEQ ID NO: 27774 - DNA, 20 bp, synthetic construct
  source 1..20: mol_type = other DNA
catgggcttggatccatgtc

SEQ ID NO: 27775 - DNA, 20 bp, synthetic construct
  source 1..20: mol_type = other DNA
catgggcttggatccatgtc

SEQ ID NO: 27776 - DNA, 20 bp, synthetic construct
  source 1..20: mol_type = other DNA
gtatacccccgaaccgtgag

SEQ ID NO: 27777 - DNA, 20 bp, synthetic construct
  source 1..20: mol_type = other DNA
tgggcttggatccatgtctg

SEQ ID NO: 27778 - DNA, 20 bp, synthetic construct
  source 1..20: mol_type = other DNA
ttcgggggtatacatgggct

SEQ ID NO: 27779 - DNA, 20 bp, synthetic construct
  source 1..20: mol_type = other DNA
atgggcttggatccatgtct

SEQ ID NO: 27780 - DNA, 20 bp, synthetic construct
  source 1..20: mol_type = other DNA
tacccccgaaccgtgagtac

SEQ ID NO: 27781 - DNA, 20 bp, synthetic construct
  source 1..20: mol_type = other DNA
catgggcttggatccatgtc

SEQ ID NO: 27782 - DNA, 20 bp, synthetic construct
  source 1..20: mol_type = other DNA
tatacccccgaaccgtgagt

SEQ ID NO: 27783 - DNA, 21 bp, synthetic construct
  source 1..21: mol_type = other DNA
atgtctgatgtactgtgtgca

SEQ ID NO: 27784 - DNA, 21 bp, synthetic construct
  source 1..21: mol_type = other DNA
tccatgtctgatgtactgtgt

SEQ ID NO: 27785 - DNA, 20 bp, synthetic construct
  source 1..20: mol_type = other DNA
atacccccgaaccgtgagta

SEQ ID NO: 27786 - DNA, 20 bp, synthetic construct
  source 1..20: mol_type = other DNA
tcctccagctaccagttgcc

SEQ ID NO: 27787 - DNA, 20 bp, synthetic construct
  source 1..20: mol_type = other DNA
atacccccgaaccgtgagta

SEQ ID NO: 27788 - DNA, 20 bp, synthetic construct
  source 1..20: mol_type = other DNA
tgggcttggatccatgtctg

SEQ ID NO: 27789 - DNA, 20 bp, synthetic construct
  source 1..20: mol_type = other DNA
tgggcttggatccatgtctg

SEQ ID NO: 27790 - DNA, 20 bp, synthetic construct
  source 1..20: mol_type = other DNA
tacccccgaaccgtgagtac

SEQ ID NO: 27791 - DNA, 23 bp, synthetic construct
  source 1..23: mol_type = other DNA
tgtatacccccgaaccgtgagta

SEQ ID NO: 27792 - DNA, 24 bp, synthetic construct
  source 1..24: mol_type = other DNA
atgtatacccccgaaccgtgagta

SEQ ID NO: 27793 - DNA, 24 bp, synthetic construct
  source 1..24: mol_type = other DNA
aactggtagctggaggacagtact

SEQ ID NO: 27794 - DNA, 21 bp, synthetic construct
  source 1..21: mol_type = other DNA
atacatgggcttggatccatg

SEQ ID NO: 27795 - DNA, 21 bp, synthetic construct
  source 1..21: mol_type = other DNA
atacatgggcttggatccatg

SEQ ID NO: 27796 - DNA, 21 bp, synthetic construct
  source 1..21: mol_type = other DNA
tgtcctccagctaccagttgc

SEQ ID NO: 27797 - DNA, 21 bp, synthetic construct
  source 1..21: mol_type = other DNA
ccgaaccgtgagtactgtcct

SEQ ID NO: 27798 - DNA, 20 bp, synthetic construct
  source 1..20: mol_type = other DNA
atacccccgaaccgtgagta

SEQ ID NO: 27799 - DNA, 20 bp, synthetic construct
  source 1..20: mol_type = other DNA
tacccccgaaccgtgagtac

SEQ ID NO: 27800 - DNA, 20 bp, synthetic construct
  source 1..20: mol_type = other DNA
gggcttggatccatgtctga

SEQ ID NO: 27801 - DNA, 23 bp, synthetic construct
  source 1..23: mol_type = other DNA
gtatacccccgaaccgtgagtac

SEQ ID NO: 27802 - DNA, 23 bp, synthetic construct
  source 1..23: mol_type = other DNA
gtatacccccgaaccgtgagtac

SEQ ID NO: 27803 - DNA, 21 bp, synthetic construct
  source 1..21: mol_type = other DNA
cccgaaccgtgagtactgtcc

SEQ ID NO: 27804 - DNA, 21 bp, synthetic construct
  source 1..21: mol_type = other DNA
ccgaaccgtgagtactgtcct

SEQ ID NO: 27805 - DNA, 20 bp, synthetic construct
  source 1..20: mol_type = other DNA
ggcttggatccatgtctgat

SEQ ID NO: 27806 - DNA, 20 bp, synthetic construct
  source 1..20: mol_type = other DNA
acccccgaaccgtgagtact

SEQ ID NO: 27807 - DNA, 21 bp, synthetic construct
  source 1..21: mol_type = other DNA
cccgaaccgtgagtactgtcc

SEQ ID NO: 27808 - DNA, 20 bp, synthetic construct
  source 1..20: mol_type = other DNA
tacccccgaaccgtgagtac

SEQ ID NO: 27809 - DNA, 20 bp, synthetic construct
  source 1..20: mol_type = other DNA
cccccgaaccgtgagtactg

SEQ ID NO: 27810 - DNA, 20 bp, synthetic construct
  source 1..20: mol_type = other DNA
gcttggatccatgtctgatg

SEQ ID NO: 27811 - DNA, 20 bp, synthetic construct
  source 1..20: mol_type = other DNA
gaaccgtgagtactgtcctc

SEQ ID NO: 27812 - DNA, 20 bp, synthetic construct
  source 1..20: mol_type = other DNA
ccccgaaccgtgagtactgt

SEQ ID NO: 27813 - DNA, 20 bp, synthetic construct
  source 1..20: mol_type = other DNA
tggatccatgtctgatgtac

SEQ ID NO: 27814 - DNA, 20 bp, synthetic construct
  source 1..20: mol_type = other DNA
cttggatccatgtctgatgt

SEQ ID NO: 27815 - DNA, 23 bp, synthetic construct
  source 1..23: mol_type = other DNA
catgggcttggatccatgtctga

SEQ ID NO: 27816 - DNA, 23 bp, synthetic construct
  source 1..23: mol_type = other DNA
catgggcttggatccatgtctga

SEQ ID NO: 27817 - DNA, 21 bp, synthetic construct
  source 1..21: mol_type = other DNA
ccgaaccgtgagtactgtcct

SEQ ID NO: 27818 - DNA, 20 bp, synthetic construct
  source 1..20: mol_type = other DNA
ttggatccatgtctgatgta

SEQ ID NO: 27819 - DNA, 20 bp, synthetic construct
  source 1..20: mol_type = other DNA
ttggatccatgtctgatgta

SEQ ID NO: 27820 - DNA, 20 bp, synthetic construct
  source 1..20: mol_type = other DNA
cccgaaccgtgagtactgtc

SEQ ID NO: 27821 - DNA, 23 bp, synthetic construct
  source 1..23: mol_type = other DNA
tacccccgaaccgtgagtactgt

SEQ ID NO: 27822 - DNA, 23 bp, synthetic construct
  source 1..23: mol_type = other DNA
tacccccgaaccgtgagtactgt

SEQ ID NO: 27823 - DNA, 21 bp, synthetic construct
  source 1..21: mol_type = other DNA
cccgaaccgtgagtactgtcc

SEQ ID NO: 27824 - DNA, 20 bp, synthetic construct
  source 1..20: mol_type = other DNA
ccgaaccgtgagtactgtcc

SEQ ID NO: 27825 - DNA, 20 bp, synthetic construct
  source 1..20: mol_type = other DNA
tggatccatgtctgatgtac

SEQ ID NO: 27826 - DNA, 23 bp, synthetic construct
  source 1..23: mol_type = other DNA
ttggatccatgtctgatgtactg

SEQ ID NO: 27827 - DNA, 21 bp, synthetic construct
  source 1..21: mol_type = other DNA
cccgaaccgtgagtactgtcc

SEQ ID NO: 27828 - DNA, 20 bp, synthetic construct
  source 1..20: mol_type = other DNA
aaccgtgagtactgtcctcc

SEQ ID NO: 27829 - DNA, 20 bp, synthetic construct
  source 1..20: mol_type = other DNA
cgaaccgtgagtactgtcct

SEQ ID NO: 27830 - DNA, 20 bp, synthetic construct
  source 1..20: mol_type = other DNA
ggatccatgtctgatgtact

SEQ ID NO: 27831 - DNA, 23 bp, synthetic construct
  source 1..23: mol_type = other DNA
aagcccatgtatacccccgaacc

SEQ ID NO: 27832 - DNA, 21 bp, synthetic construct
  source 1..21: mol_type = other DNA
cccgaaccgtgagtactgtcc

SEQ ID NO: 27833 - DNA, 20 bp, synthetic construct
  source 1..20: mol_type = other DNA
gaaccgtgagtactgtcctc

SEQ ID NO: 27834 - DNA, 20 bp, synthetic construct
  source 1..20: mol_type = other DNA
tcctccagctaccagttgcc

SEQ ID NO: 27835 - DNA, 20 bp, synthetic construct
  source 1..20: mol_type = other DNA
gaaccgtgagtactgtcctc

SEQ ID NO: 27836 - DNA, 20 bp, synthetic construct
  source 1..20: mol_type = other DNA
aaccgtgagtactgtcctcc

SEQ ID NO: 27837 - DNA, 20 bp, synthetic construct
  source 1..20: mol_type = other DNA
gatccatgtctgatgtactg

SEQ ID NO: 27838 - DNA, 20 bp, synthetic construct
  source 1..20: mol_type = other DNA
gatccatgtctgatgtactg

SEQ ID NO: 27839 - DNA, 23 bp, synthetic construct
  source 1..23: mol_type = other DNA
aagcccatgtatacccccgaacc

SEQ ID NO: 27840 - DNA, 21 bp, synthetic construct
  source 1..21: mol_type = other DNA
cccgaaccgtgagtactgtcc

SEQ ID NO: 27841 - DNA, 21 bp, synthetic construct
  source 1..21: mol_type = other DNA
tgtcctccagctaccagttgc

SEQ ID NO: 27842 - DNA, 21 bp, synthetic construct
  source 1..21: mol_type = other DNA
ccgaaccgtgagtactgtcct

SEQ ID NO: 27843 - DNA, 20 bp, synthetic construct
  source 1..20: mol_type = other DNA
gaaccgtgagtactgtcctc

SEQ ID NO: 27844 - DNA, 20 bp, synthetic construct
  source 1..20: mol_type = other DNA
aaccgtgagtactgtcctcc

SEQ ID NO: 27845 - DNA, 20 bp, synthetic construct
  source 1..20: mol_type = other DNA
atccatgtctgatgtactgt

SEQ ID NO: 27846 - DNA, 20 bp, synthetic construct
  source 1..20: mol_type = other DNA
atccatgtctgatgtactgt

SEQ ID NO: 27847 - DNA, 20 bp, synthetic construct
  source 1..20: mol_type = other DNA
agcgccatcttttcctgctg

SEQ ID NO: 27848 - DNA, 21 bp, synthetic construct
  source 1..21: mol_type = other DNA
cgtgagtactgtcctccagct

SEQ ID NO: 27849 - DNA, 21 bp, synthetic construct
  source 1..21: mol_type = other DNA
ccgaaccgtgagtactgtcct

SEQ ID NO: 27850 - DNA, 21 bp, synthetic construct
  source 1..21: mol_type = other DNA
tccatgtctgatgtactgtgt

SEQ ID NO: 27851 - DNA, 20 bp, synthetic construct
  source 1..20: mol_type = other DNA
aaccgtgagtactgtcctcc

SEQ ID NO: 27852 - DNA, 20 bp, synthetic construct
  source 1..20: mol_type = other DNA
accgtgagtactgtcctcca

SEQ ID NO: 27853 - DNA, 20 bp, synthetic construct
  source 1..20: mol_type = other DNA
tccatgtctgatgtactgtg

SEQ ID NO: 27854 - DNA, 20 bp, synthetic construct
  source 1..20: mol_type = other DNA
agcgccatcttttcctgctg

SEQ ID NO: 27855 - DNA, 23 bp, synthetic construct
  source 1..23: mol_type = other DNA
ttggatccatgtctgatgtactg

SEQ ID NO: 27856 - DNA, 23 bp, synthetic construct
  source 1..23: mol_type = other DNA
ttggatccatgtctgatgtactg

SEQ ID NO: 27857 - DNA, 23 bp, synthetic construct
  source 1..23: mol_type = other DNA
aagcccatgtatacccccgaacc

SEQ ID NO: 27858 - DNA, 21 bp, synthetic construct
  source 1..21: mol_type = other DNA
cgtgagtactgtcctccagct

SEQ ID NO: 27859 - DNA, 21 bp, synthetic construct
  source 1..21: mol_type = other DNA
atccatgtctgatgtactgtg

SEQ ID NO: 27860 - DNA, 20 bp, synthetic construct
  source 1..20: mol_type = other DNA
gaaccgtgagtactgtcctc

SEQ ID NO: 27861 - DNA, 20 bp, synthetic construct
  source 1..20: mol_type = other DNA
ccgtgagtactgtcctccag

SEQ ID NO: 27862 - DNA, 20 bp, synthetic construct
  source 1..20: mol_type = other DNA
ccatgtctgatgtactgtgt

SEQ ID NO: 27863 - DNA, 21 bp, synthetic construct
  source 1..21: mol_type = other DNA
cgtgagtactgtcctccagct

SEQ ID NO: 27864 - DNA, 21 bp, synthetic construct
  source 1..21: mol_type = other DNA
gtgagtactgtcctccagcta

SEQ ID NO: 27865 - DNA, 20 bp, synthetic construct
  source 1..20: mol_type = other DNA
aaccgtgagtactgtcctcc

SEQ ID NO: 27866 - DNA, 20 bp, synthetic construct
  source 1..20: mol_type = other DNA
cgtgagtactgtcctccagc

SEQ ID NO: 27867 - DNA, 20 bp, synthetic construct
  source 1..20: mol_type = other DNA
catgtctgatgtactgtgtg

SEQ ID NO: 27868-28052 - skipped (185 entries)

SEQ ID NO: 28053 - DNA, 20 bp, synthetic construct
  source 1..20: mol_type = other DNA
gagacctttaggtagtggag

SEQ ID NO: 28054 - DNA, 20 bp, synthetic construct
  source 1..20: mol_type = other DNA
acctttaggtagtggagtag

SEQ ID NO: 28055 - DNA, 21 bp, synthetic construct
  source 1..21: mol_type = other DNA
tgtgtactactccactaccta

SEQ ID NO: 28056 - DNA, 21 bp, synthetic construct
  source 1..21: mol_type = other DNA
atgtgtactactccactacct

SEQ ID NO: 28057 - DNA, 20 bp, synthetic construct
  source 1..20: mol_type = other DNA
gtgtactactccactaccta

SEQ ID NO: 28058 - DNA, 20 bp, synthetic construct
  source 1..20: mol_type = other DNA
cagttatgtgtactactcca

SEQ ID NO: 28059 - DNA, 20 bp, synthetic construct
  source 1..20: mol_type = other DNA
cctttaggtagtggagtagt

SEQ ID NO: 28060 - DNA, 23 bp, synthetic construct
  source 1..23: mol_type = other DNA
gggcagttatgtgtactactcca

SEQ ID NO: 28061 - DNA, 23 bp, synthetic construct
  source 1..23: mol_type = other DNA
gggcagttatgtgtactactcca

SEQ ID NO: 28062 - DNA, 21 bp, synthetic construct
  source 1..21: mol_type = other DNA
gttatgtgtactactccacta

SEQ ID NO: 28063 - DNA, 21 bp, synthetic construct
  source 1..21: mol_type = other DNA
atgtgtactactccactacct

SEQ ID NO: 28064 - DNA, 20 bp, synthetic construct
  source 1..20: mol_type = other DNA
tgtactactccactacctaa

SEQ ID NO: 28065 - DNA, 20 bp, synthetic construct
  source 1..20: mol_type = other DNA
agttatgtgtactactccac

SEQ ID NO: 28066 - DNA, 20 bp, synthetic construct
  source 1..20: mol_type = other DNA
ctttaggtagtggagtagta

SEQ ID NO: 28067 - DNA, 23 bp, synthetic construct
  source 1..23: mol_type = other DNA
gcctagcgtcaaagcctatgtcc

SEQ ID NO: 28068 - DNA, 21 bp, synthetic construct
  source 1..21: mol_type = other DNA
gttatgtgtactactccacta

SEQ ID NO: 28069 - DNA, 20 bp, synthetic construct
  source 1..20: mol_type = other DNA
gtgtactactccactaccta

SEQ ID NO: 28070 - DNA, 20 bp, synthetic construct
  source 1..20: mol_type = other DNA
tgtactactccactacctaa

SEQ ID NO: 28071 - DNA, 20 bp, synthetic construct
  source 1..20: mol_type = other DNA
gttatgtgtactactccact

SEQ ID NO: 28072 - DNA, 20 bp, synthetic construct
  source 1..20: mol_type = other DNA
tgtactactccactacctaa

SEQ ID NO: 28073 - DNA, 20 bp, synthetic construct
  source 1..20: mol_type = other DNA
tttaggtagtggagtagtac

SEQ ID NO: 28074 - DNA, 23 bp, synthetic construct
  source 1..23: mol_type = other DNA
gcctagcgtcaaagcctatgtcc

SEQ ID NO: 28075 - DNA, 21 bp, synthetic construct
  source 1..21: mol_type = other DNA
gttatgtgtactactccacta

SEQ ID NO: 28076 - DNA, 21 bp, synthetic construct
  source 1..21: mol_type = other DNA
tgtgtactactccactaccta

SEQ ID NO: 28077 - DNA, 21 bp, synthetic construct
  source 1..21: mol_type = other DNA
atgtgtactactccactacct

SEQ ID NO: 28078 - DNA, 20 bp, synthetic construct
  source 1..20: mol_type = other DNA
gtgtactactccactaccta

SEQ ID NO: 28079 - DNA, 20 bp, synthetic construct
  source 1..20: mol_type = other DNA
ttatgtgtactactccacta

SEQ ID NO: 28080 - DNA, 20 bp, synthetic construct
  source 1..20: mol_type = other DNA
ttaggtagtggagtagtaca

SEQ ID NO: 28081 - DNA, 23 bp, synthetic construct
  source 1..23: mol_type = other DNA
ctttaggtagtggagtagtacac

SEQ ID NO: 28082 - DNA, 23 bp, synthetic construct
  source 1..23: mol_type = other DNA
ctttaggtagtggagtagtacac

SEQ ID NO: 28083 - DNA, 24 bp, synthetic construct
  source 1..24: mol_type = other DNA
ttaggtagtggagtagtacacata

SEQ ID NO: 28084 - DNA, 21 bp, synthetic construct
  source 1..21: mol_type = other DNA
ttatgtgtactactccactac

SEQ ID NO: 28085 - DNA, 20 bp, synthetic construct
  source 1..20: mol_type = other DNA
tatgtgtactactccactac

SEQ ID NO: 28086 - DNA, 20 bp, synthetic construct
  source 1..20: mol_type = other DNA
taggtagtggagtagtacac

SEQ ID NO: 28087 - DNA, 23 bp, synthetic construct
  source 1..23: mol_type = other DNA
ctttaggtagtggagtagtacac

SEQ ID NO: 28088 - DNA, 23 bp, synthetic construct
  source 1..23: mol_type = other DNA
ctttaggtagtggagtagtacac

SEQ ID NO: 28089 - DNA, 21 bp, synthetic construct
  source 1..21: mol_type = other DNA
tttaggtagtggagtagtaca

SEQ ID NO: 28090 - DNA, 20 bp, synthetic construct
  source 1..20: mol_type = other DNA
tgtactactccactacctaa

SEQ ID NO: 28091 - DNA, 20 bp, synthetic construct
  source 1..20: mol_type = other DNA
atgtgtactactccactacc

SEQ ID NO: 28092 - DNA, 20 bp, synthetic construct
  source 1..20: mol_type = other DNA
aggtagtggagtagtacaca

SEQ ID NO: 28093 - DNA, 20 bp, synthetic construct
  source 1..20: mol_type = other DNA
gtgtactactccactaccta

SEQ ID NO: 28094 - DNA, 20 bp, synthetic construct
  source 1..20: mol_type = other DNA
tgtactactccactacctaa

SEQ ID NO: 28095 - DNA, 20 bp, synthetic construct
  source 1..20: mol_type = other DNA
tgtgtactactccactacct

SEQ ID NO: 28096 - DNA, 20 bp, synthetic construct
  source 1..20: mol_type = other DNA
tgtactactccactacctaa

SEQ ID NO: 28097 - DNA, 20 bp, synthetic construct
  source 1..20: mol_type = other DNA
ggtagtggagtagtacacat

SEQ ID NO: 28098 - DNA, 21 bp, synthetic construct
  source 1..21: mol_type = other DNA
tgtgtactactccactaccta

SEQ ID NO: 28099 - DNA, 21 bp, synthetic construct
  source 1..21: mol_type = other DNA
tgtgtactactccactaccta

SEQ ID NO: 28100 - DNA, 20 bp, synthetic construct
  source 1..20: mol_type = other DNA
gtgtactactccactaccta

SEQ ID NO: 28101 - DNA, 20 bp, synthetic construct
  source 1..20: mol_type = other DNA
gtgtactactccactaccta

SEQ ID NO: 28102 - DNA, 20 bp, synthetic construct
  source 1..20: mol_type = other DNA
gtagtggagtagtacacata

SEQ ID NO: 28103 - DNA, 23 bp, synthetic construct
  source 1..23: mol_type = other DNA
taggtagtggagtagtacacata

SEQ ID NO: 28104 - DNA, 24 bp, synthetic construct
  source 1..24: mol_type = other DNA
taggtagtggagtagtacacataa

SEQ ID NO: 28105 - DNA, 24 bp, synthetic construct
  source 1..24: mol_type = other DNA
ctagcgtcaaagcctatgtccctg

SEQ ID NO: 28106 - DNA, 21 bp, synthetic construct
  source 1..21: mol_type = other DNA
atgtgtactactccactacct

SEQ ID NO: 28107 - DNA, 21 bp, synthetic construct
  source 1..21: mol_type = other DNA
atgtgtactactccactacct

SEQ ID NO: 28108 - DNA, 21 bp, synthetic construct
  source 1..21: mol_type = other DNA
tgtgtactactccactaccta

SEQ ID NO: 28109 - DNA, 20 bp, synthetic construct
  source 1..20: mol_type = other DNA
tgtactactccactacctaa

SEQ ID NO: 28110 - DNA, 20 bp, synthetic construct
  source 1..20: mol_type = other DNA
tagtggagtagtacacataa

SEQ ID NO: 28111 - DNA, 23 bp, synthetic construct
  source 1..23: mol_type = other DNA
aggtagtggagtagtacacataa

SEQ ID NO: 28112 - DNA, 23 bp, synthetic construct
  source 1..23: mol_type = other DNA
aggtagtggagtagtacacataa

SEQ ID NO: 28113 - DNA, 23 bp, synthetic construct
  source 1..23: mol_type = other DNA
aggtagtggagtagtacacataa

SEQ ID NO: 28114 - DNA, 21 bp, synthetic construct
  source 1..21: mol_type = other DNA
atgtgtactactccactacct

SEQ ID NO: 28115 - DNA, 20 bp, synthetic construct
  source 1..20: mol_type = other DNA
agtggagtagtacacataac

SEQ ID NO: 28116 - DNA, 20 bp, synthetic construct
  source 1..20: mol_type = other DNA
gtactactccactacctaaa

SEQ ID NO: 28117 - DNA, 20 bp, synthetic construct
  source 1..20: mol_type = other DNA
agtggagtagtacacataac

SEQ ID NO: 28118 - DNA, 20 bp, synthetic construct
  source 1..20: mol_type = other DNA
tagtggagtagtacacataa

SEQ ID NO: 28119 - DNA, 20 bp, synthetic construct
  source 1..20: mol_type = other DNA
gtggagtagtacacataact

SEQ ID NO: 28120 - DNA, 20 bp, synthetic construct
  source 1..20: mol_type = other DNA
tactactccactacctaaag

SEQ ID NO: 28121 - DNA, 23 bp, synthetic construct
  source 1..23: mol_type = other DNA
ggtagtggagtagtacacataac

SEQ ID NO: 28122 - DNA, 24 bp, synthetic construct
  source 1..24: mol_type = other DNA
taggtagtggagtagtacacataa

SEQ ID NO: 28123 - DNA, 20 bp, synthetic construct
  source 1..20: mol_type = other DNA
actactccactacctaaagg

SEQ ID NO: 28124 - DNA, 20 bp, synthetic construct
  source 1..20: mol_type = other DNA
tggagtagtacacataactg

SEQ ID NO: 28125 - DNA, 23 bp, synthetic construct
  source 1..23: mol_type = other DNA
tgtactactccactacctaaagg

SEQ ID NO: 28126 - DNA, 23 bp, synthetic construct
  source 1..23: mol_type = other DNA
tgtactactccactacctaaagg

SEQ ID NO: 28127 - DNA, 23 bp, synthetic construct
  source 1..23: mol_type = other DNA
ggtagtggagtagtacacataac

SEQ ID NO: 28128 - DNA, 20 bp, synthetic construct
  source 1..20: mol_type = other DNA
gtactactccactacctaaa

SEQ ID NO: 28129 - DNA, 20 bp, synthetic construct
  source 1..20: mol_type = other DNA
ctactccactacctaaaggt

SEQ ID NO: 28130 - DNA, 20 bp, synthetic construct
  source 1..20: mol_type = other DNA
ggagtagtacacataactgc

SEQ ID NO: 28131 - DNA, 20 bp, synthetic construct
  source 1..20: mol_type = other DNA
tccactacctaaaggtctcc

SEQ ID NO: 28132 - DNA, 20 bp, synthetic construct
  source 1..20: mol_type = other DNA
tactccactacctaaaggtc

SEQ ID NO: 28133 - DNA, 20 bp, synthetic construct
  source 1..20: mol_type = other DNA
gagtagtacacataactgcc

SEQ ID NO: 28134 - DNA, 23 bp, synthetic construct
  source 1..23: mol_type = other DNA
tgtactactccactacctaaagg

SEQ ID NO: 28135 - DNA, 23 bp, synthetic construct
  source 1..23: mol_type = other DNA
ggagtagtacacataactgccca

SEQ ID NO: 28136 - DNA, 24 bp, synthetic construct
  source 1..24: mol_type = other DNA
tactccactacctaaaggtctcct

SEQ ID NO: 28137 - DNA, 24 bp, synthetic construct
  source 1..24: mol_type = other DNA
taggtagtggagtagtacacataa

SEQ ID NO: 28138 - DNA, 21 bp, synthetic construct
  source 1..21: mol_type = other DNA
actccactacctaaaggtctc

SEQ ID NO: 28139 - DNA, 20 bp, synthetic construct
  source 1..20: mol_type = other DNA
actccactacctaaaggtct

SEQ ID NO: 28140 - DNA, 20 bp, synthetic construct
  source 1..20: mol_type = other DNA
agtagtacacataactgccc

SEQ ID NO: 28141 - DNA, 23 bp, synthetic construct
  source 1..23: mol_type = other DNA
actccactacctaaaggtctcct

SEQ ID NO: 28142 - DNA, 23 bp, synthetic construct
  source 1..23: mol_type = other DNA
ggagtagtacacataactgccca

SEQ ID NO: 28143 - DNA, 21 bp, synthetic construct
  source 1..21: mol_type = other DNA
tactccactacctaaaggtct

SEQ ID NO: 28144 - DNA, 20 bp, synthetic construct
  source 1..20: mol_type = other DNA
gtagtacacataactgccca

SEQ ID NO: 28145 - DNA, 20 bp, synthetic construct
  source 1..20: mol_type = other DNA
gtagtacacataactgccca

SEQ ID NO: 28146 - DNA, 20 bp, synthetic construct
  source 1..20: mol_type = other DNA
ctccactacctaaaggtctc

SEQ ID NO: 28147 - DNA, 20 bp, synthetic construct
  source 1..20: mol_type = other DNA
gtagtacacataactgccca

SEQ ID NO: 28148 - DNA, 20 bp, synthetic construct
  source 1..20: mol_type = other DNA
gtagtacacataactgccca

SEQ ID NO: 28149 - DNA, 20 bp, synthetic construct
  source 1..20: mol_type = other DNA
tagtacacataactgcccag

SEQ ID NO: 28150 - DNA, 20 bp, synthetic construct
  source 1..20: mol_type = other DNA
ccactacctaaaggtctcct

SEQ ID NO: 28151 - DNA, 20 bp, synthetic construct
  source 1..20: mol_type = other DNA
tagtacacataactgcccag

SEQ ID NO: 28152 - DNA, 20 bp, synthetic construct
  source 1..20: mol_type = other DNA
tccactacctaaaggtctcc

SEQ ID NO: 28153 - DNA, 21 bp, synthetic construct
  source 1..21: mol_type = other DNA
gagtagtacacataactgccc

SEQ ID NO: 28154 - DNA, 21 bp, synthetic construct
  source 1..21: mol_type = other DNA
gagtagtacacataactgccc

SEQ ID NO: 28155 - DNA, 20 bp, synthetic construct
  source 1..20: mol_type = other DNA
cactacctaaaggtctccta

SEQ ID NO: 28156 - DNA, 20 bp, synthetic construct
  source 1..20: mol_type = other DNA
tgtactactccactacctaa

SEQ ID NO: 28157 - DNA, 20 bp, synthetic construct
  source 1..20: mol_type = other DNA
ccactacctaaaggtctcct

SEQ ID NO: 28158 - DNA, 20 bp, synthetic construct
  source 1..20: mol_type = other DNA
gtagtacacataactgccca

SEQ ID NO: 28159 - DNA, 20 bp, synthetic construct
  source 1..20: mol_type = other DNA
agtacacataactgcccagg

SEQ ID NO: 28160 - DNA, 20 bp, synthetic construct
  source 1..20: mol_type = other DNA
ccactacctaaaggtctcct

SEQ ID NO: 28161 - DNA, 23 bp, synthetic construct
  source 1..23: mol_type = other DNA
actccactacctaaaggtctcct

SEQ ID NO: 28162 - DNA, 24 bp, synthetic construct
  source 1..24: mol_type = other DNA
tactccactacctaaaggtctcct

SEQ ID NO: 28163 - skipped

SEQ ID NO: 28164 - DNA, 21 bp, synthetic construct
  source 1..21: mol_type = other DNA
gtacacataactgcccaggga

SEQ ID NO: 28165 - DNA, 21 bp, synthetic construct
  source 1..21: mol_type = other DNA
gtacacataactgcccaggga

SEQ ID NO: 28166 - DNA, 21 bp, synthetic construct
  source 1..21: mol_type = other DNA
tgtgtactactccactaccta

SEQ ID NO: 28167 - DNA, 21 bp, synthetic construct
  source 1..21: mol_type = other DNA
actccactacctaaaggtctc

SEQ ID NO: 28168 - DNA, 20 bp, synthetic construct
  source 1..20: mol_type = other DNA
cactacctaaaggtctccta

SEQ ID NO: 28169 - DNA, 20 bp, synthetic construct
  source 1..20: mol_type = other DNA
cactacctaaaggtctccta

SEQ ID NO: 28170 - DNA, 20 bp, synthetic construct
  source 1..20: mol_type = other DNA
gtacacataactgcccaggg

SEQ ID NO: 28171 - DNA, 23 bp, synthetic construct
  source 1..23: mol_type = other DNA
ctccactacctaaaggtctccta

SEQ ID NO: 28172 - DNA, 23 bp, synthetic construct
  source 1..23: mol_type = other DNA
ctccactacctaaaggtctccta

SEQ ID NO: 28173 - DNA, 21 bp, synthetic construct
  source 1..21: mol_type = other DNA
acctaaaggtctcctagtgcc

SEQ ID NO: 28174 - DNA, 21 bp, synthetic construct
  source 1..21: mol_type = other DNA
actccactacctaaaggtctc

SEQ ID NO: 28175 - DNA, 20 bp, synthetic construct
  source 1..20: mol_type = other DNA
tacacataactgcccaggga

SEQ ID NO: 28176 - DNA, 20 bp, synthetic construct
  source 1..20: mol_type = other DNA
actacctaaaggtctcctag

SEQ ID NO: 28177 - DNA, 21 bp, synthetic construct
  source 1..21: mol_type = other DNA
acctaaaggtctcctagtgcc

SEQ ID NO: 28178 - DNA, 20 bp, synthetic construct
  source 1..20: mol_type = other DNA
actacctaaaggtctcctag

SEQ ID NO: 28179 - DNA, 20 bp, synthetic construct
  source 1..20: mol_type = other DNA
ctacctaaaggtctcctagt

SEQ ID NO: 28180 - DNA, 20 bp, synthetic construct
  source 1..20: mol_type = other DNA
acacataactgcccagggac

SEQ ID NO: 28181 - DNA, 20 bp, synthetic construct
  source 1..20: mol_type = other DNA
cactacctaaaggtctccta

SEQ ID NO: 28182 - DNA, 20 bp, synthetic construct
  source 1..20: mol_type = other DNA
tacctaaaggtctcctagtg

SEQ ID NO: 28183 - DNA, 20 bp, synthetic construct
  source 1..20: mol_type = other DNA
acataactgcccagggacat

SEQ ID NO: 28184 - DNA, 20 bp, synthetic construct
  source 1..20: mol_type = other DNA
cacataactgcccagggaca

SEQ ID NO: 28185 - DNA, 23 bp, synthetic construct
  source 1..23: mol_type = other DNA
gtacacataactgcccagggaca

SEQ ID NO: 28186 - DNA, 23 bp, synthetic construct
  source 1..23: mol_type = other DNA
gtacacataactgcccagggaca

SEQ ID NO: 28187 - DNA, 21 bp, synthetic construct
  source 1..21: mol_type = other DNA
actccactacctaaaggtctc

SEQ ID NO: 28188 - DNA, 20 bp, synthetic construct
  source 1..20: mol_type = other DNA
acataactgcccagggacat

SEQ ID NO: 28189 - DNA, 20 bp, synthetic construct
  source 1..20: mol_type = other DNA
acataactgcccagggacat

SEQ ID NO: 28190 - DNA, 20 bp, synthetic construct
  source 1..20: mol_type = other DNA
acctaaaggtctcctagtgc

SEQ ID NO: 28191 - DNA, 23 bp, synthetic construct
  source 1..23: mol_type = other DNA
ccactacctaaaggtctcctagt

SEQ ID NO: 28192 - DNA, 23 bp, synthetic construct
  source 1..23: mol_type = other DNA
ccactacctaaaggtctcctagt

SEQ ID NO: 28193 - DNA, 21 bp, synthetic construct
  source 1..21: mol_type = other DNA
acctaaaggtctcctagtgcc

SEQ ID NO: 28194 - DNA, 20 bp, synthetic construct
  source 1..20: mol_type = other DNA
cctaaaggtctcctagtgcc

SEQ ID NO: 28195 - DNA, 20 bp, synthetic construct
  source 1..20: mol_type = other DNA
cataactgcccagggacata

SEQ ID NO: 28196 - DNA, 23 bp, synthetic construct
  source 1..23: mol_type = other DNA
gtacacataactgcccagggaca

SEQ ID NO: 28197 - DNA, 21 bp, synthetic construct
  source 1..21: mol_type = other DNA
acctaaaggtctcctagtgcc

SEQ ID NO: 28198 - DNA, 20 bp, synthetic construct
  source 1..20: mol_type = other DNA
taaaggtctcctagtgcctc

SEQ ID NO: 28199 - DNA, 20 bp, synthetic construct
  source 1..20: mol_type = other DNA
ctaaaggtctcctagtgcct

SEQ ID NO: 28200 - DNA, 20 bp, synthetic construct
  source 1..20: mol_type = other DNA
ataactgcccagggacatag

SEQ ID NO: 28201 - DNA, 23 bp, synthetic construct
  source 1..23: mol_type = other DNA
ctagtgcctctgactcagtggtg

SEQ ID NO: 28202 - DNA, 21 bp, synthetic construct
  source 1..21: mol_type = other DNA
acctaaaggtctcctagtgcc

SEQ ID NO: 28203 - DNA, 20 bp, synthetic construct
  source 1..20: mol_type = other DNA
ctaaaggtctcctagtgcct

SEQ ID NO: 28204 - DNA, 20 bp, synthetic construct
  source 1..20: mol_type = other DNA
tcctagtgcctctgactcag

SEQ ID NO: 28205 - DNA, 20 bp, synthetic construct
  source 1..20: mol_type = other DNA
taaaggtctcctagtgcctc

SEQ ID NO: 28206 - DNA, 20 bp, synthetic construct
  source 1..20: mol_type = other DNA
taaaggtctcctagtgcctc

SEQ ID NO: 28207 - DNA, 20 bp, synthetic construct
  source 1..20: mol_type = other DNA
cataactgcccagggacata

SEQ ID NO: 28208 - DNA, 20 bp, synthetic construct
  source 1..20: mol_type = other DNA
taactgcccagggacatagg

SEQ ID NO: 28209 - DNA, 23 bp, synthetic construct
  source 1..23: mol_type = other DNA
ctagtgcctctgactcagtggtg

SEQ ID NO: 28210 - DNA, 21 bp, synthetic construct
  source 1..21: mol_type = other DNA
aaggtctcctagtgcctctga

SEQ ID NO: 28211 - DNA, 21 bp, synthetic construct
  source 1..21: mol_type = other DNA
tctcctagtgcctctgactca

SEQ ID NO: 28212 - DNA, 21 bp, synthetic construct
  source 1..21: mol_type = other DNA
aggtctcctagtgcctctgac

SEQ ID NO: 28213 - DNA, 20 bp, synthetic construct
  source 1..20: mol_type = other DNA
ctaaaggtctcctagtgcct

SEQ ID NO: 28214 - DNA, 20 bp, synthetic construct
  source 1..20: mol_type = other DNA
aaaggtctcctagtgcctct

SEQ ID NO: 28215 - DNA, 20 bp, synthetic construct
  source 1..20: mol_type = other DNA
actgcccagggacataggct

SEQ ID NO: 28216 - DNA, 20 bp, synthetic construct
  source 1..20: mol_type = other DNA
aactgcccagggacataggc

SEQ ID NO: 28217 - skipped

SEQ ID NO: 28218 - DNA, 21 bp, synthetic construct
  source 1..21: mol_type = other DNA
aaggtctcctagtgcctctga

SEQ ID NO: 28219 - DNA, 21 bp, synthetic construct
  source 1..21: mol_type = other DNA
aggtctcctagtgcctctgac

SEQ ID NO: 28220 - DNA, 21 bp, synthetic construct
  source 1..21: mol_type = other DNA
acacataactgcccagggaca

SEQ ID NO: 28221 - DNA, 20 bp, synthetic construct
  source 1..20: mol_type = other DNA
taaaggtctcctagtgcctc

SEQ ID NO: 28222 - DNA, 20 bp, synthetic construct
  source 1..20: mol_type = other DNA
aaggtctcctagtgcctctg

SEQ ID NO: 28223 - DNA, 20 bp, synthetic construct
  source 1..20: mol_type = other DNA
actgcccagggacataggct

SEQ ID NO: 28224 - skipped

SEQ ID NO: 28225 - DNA, 23 bp, synthetic construct
  source 1..23: mol_type = other DNA
ataactgcccagggacataggct

SEQ ID NO: 28226 - DNA, 23 bp, synthetic construct
  source 1..23: mol_type = other DNA
ataactgcccagggacataggct

SEQ ID NO: 28227 - DNA, 23 bp, synthetic construct
  source 1..23: mol_type = other DNA
ctagtgcctctgactcagtggtg

SEQ ID NO: 28228 - DNA, 21 bp, synthetic construct
  source 1..21: mol_type = other DNA
aaggtctcctagtgcctctga

SEQ ID NO: 28229 - DNA, 21 bp, synthetic construct
  source 1..21: mol_type = other DNA
taactgcccagggacataggc

SEQ ID NO: 28230 - DNA, 20 bp, synthetic construct
  source 1..20: mol_type = other DNA
gtctcctagtgcctctgact

SEQ ID NO: 28231 - DNA, 20 bp, synthetic construct
  source 1..20: mol_type = other DNA
aggtctcctagtgcctctga

SEQ ID NO: 28232 - DNA, 20 bp, synthetic construct
  source 1..20: mol_type = other DNA
ctgcccagggacataggctt

SEQ ID NO: 28233 - DNA, 21 bp, synthetic construct
  source 1..21: mol_type = other DNA
aaggtctcctagtgcctctga

SEQ ID NO: 28234 - DNA, 21 bp, synthetic construct
  source 1..21: mol_type = other DNA
aggtctcctagtgcctctgac

SEQ ID NO: 28235 - DNA, 20 bp, synthetic construct
  source 1..20: mol_type = other DNA
tctcctagtgcctctgactc

SEQ ID NO: 28236 - DNA, 20 bp, synthetic construct
  source 1..20: mol_type = other DNA
ggtctcctagtgcctctgac

SEQ ID NO: 28237 - DNA, 20 bp, synthetic construct
  source 1..20: mol_type = other DNA
tgcccagggacataggcttt

SEQ ID NO: 28238-28422 - skipped (185 entries)

SEQ ID NO: 28423 - DNA, 20 bp, synthetic construct
  source 1..20: mol_type = other DNA
tctctgccacgtaatagagg

SEQ ID NO: 28424 - DNA, 21 bp, synthetic construct
  source 1..21: mol_type = other DNA
ggagttccagcccctctatta

SEQ ID NO: 28425 - DNA, 20 bp, synthetic construct
  source 1..20: mol_type = other DNA
tctctgccacgtaatagagg

SEQ ID NO: 28426 - DNA, 20 bp, synthetic construct
  source 1..20: mol_type = other DNA
gagttccagcccctctatta

SEQ ID NO: 28427 - DNA, 20 bp, synthetic construct
  source 1..20: mol_type = other DNA
ctctgccacgtaatagaggg

SEQ ID NO: 28428 - DNA, 20 bp, synthetic construct
  source 1..20: mol_type = other DNA
ggagttccagcccctctatt

SEQ ID NO: 28429 - DNA, 20 bp, synthetic construct
  source 1..20: mol_type = other DNA
tctgccacgtaatagagggg

SEQ ID NO: 28430 - DNA, 20 bp, synthetic construct
  source 1..20: mol_type = other DNA
ctgccacgtaatagaggggc

SEQ ID NO: 28431 - DNA, 20 bp, synthetic construct
  source 1..20: mol_type = other DNA
tctgccacgtaatagagggg

SEQ ID NO: 28432 - DNA, 20 bp, synthetic construct
  source 1..20: mol_type = other DNA
ggagttccagcccctctatt

SEQ ID NO: 28433 - DNA, 20 bp, synthetic construct
  source 1..20: mol_type = other DNA
gagttccagcccctctatta

SEQ ID NO: 28434 - DNA, 20 bp, synthetic construct
  source 1..20: mol_type = other DNA
ctgccacgtaatagaggggc

SEQ ID NO: 28435 - DNA, 23 bp, synthetic construct
  source 1..23: mol_type = other DNA
ctctgccacgtaatagaggggct

SEQ ID NO: 28436 - DNA, 24 bp, synthetic construct
  source 1..24: mol_type = other DNA
tctgccacgtaatagaggggctgg

SEQ ID NO: 28437 - DNA, 21 bp, synthetic construct
  source 1..21: mol_type = other DNA
ctctgccacgtaatagagggg

SEQ ID NO: 28438 - DNA, 21 bp, synthetic construct
  source 1..21: mol_type = other DNA
ctctgccacgtaatagagggg

SEQ ID NO: 28439 - DNA, 21 bp, synthetic construct
  source 1..21: mol_type = other DNA
gagttccagcccctctattac

SEQ ID NO: 28440 - DNA, 20 bp, synthetic construct
  source 1..20: mol_type = other DNA
ctgccacgtaatagaggggc

SEQ ID NO: 28441 - DNA, 20 bp, synthetic construct
  source 1..20: mol_type = other DNA
ctgccacgtaatagaggggc

SEQ ID NO: 28442 - DNA, 20 bp, synthetic construct
  source 1..20: mol_type = other DNA
ctgccacgtaatagaggggc

SEQ ID NO: 28443 - DNA, 20 bp, synthetic construct
  source 1..20: mol_type = other DNA
ctgccacgtaatagaggggc

SEQ ID NO: 28444 - DNA, 20 bp, synthetic construct
  source 1..20: mol_type = other DNA
agttccagcccctctattac

SEQ ID NO: 28445 - DNA, 23 bp, synthetic construct
  source 1..23: mol_type = other DNA
ctctgccacgtaatagaggggct

SEQ ID NO: 28446 - DNA, 23 bp, synthetic construct
  source 1..23: mol_type = other DNA
ctctgccacgtaatagaggggct

SEQ ID NO: 28447 - DNA, 23 bp, synthetic construct
  source 1..23: mol_type = other DNA
tctctgccacgtaatagaggggc

SEQ ID NO: 28448 - DNA, 21 bp, synthetic construct
  source 1..21: mol_type = other DNA
tctgccacgtaatagaggggc

SEQ ID NO: 28449 - DNA, 21 bp, synthetic construct
  source 1..21: mol_type = other DNA
gttccagcccctctattacgt

SEQ ID NO: 28450 - DNA, 21 bp, synthetic construct
  source 1..21: mol_type = other DNA
gttccagcccctctattacgt

SEQ ID NO: 28451 - DNA, 21 bp, synthetic construct
  source 1..21: mol_type = other DNA
ctctgccacgtaatagagggg

SEQ ID NO: 28452 - DNA, 21 bp, synthetic construct
  source 1..21: mol_type = other DNA
ctctgccacgtaatagagggg

SEQ ID NO: 28453 - DNA, 20 bp, synthetic construct
  source 1..20: mol_type = other DNA
ctgccacgtaatagaggggc

SEQ ID NO: 28454 - DNA, 20 bp, synthetic construct
  source 1..20: mol_type = other DNA
tgccacgtaatagaggggct

SEQ ID NO: 28455 - DNA, 20 bp, synthetic construct
  source 1..20: mol_type = other DNA
gttccagcccctctattacg

SEQ ID NO: 28456 - DNA, 21 bp, synthetic construct
  source 1..21: mol_type = other DNA
gttccagcccctctattacgt

SEQ ID NO: 28457 - DNA, 21 bp, synthetic construct
  source 1..21: mol_type = other DNA
tctgccacgtaatagaggggc

SEQ ID NO: 28458 - DNA, 21 bp, synthetic construct
  source 1..21: mol_type = other DNA
ctctgccacgtaatagagggg

SEQ ID NO: 28459 - DNA, 20 bp, synthetic construct
  source 1..20: mol_type = other DNA
ttccagcccctctattacgt

SEQ ID NO: 28460 - DNA, 20 bp, synthetic construct
  source 1..20: mol_type = other DNA
gccacgtaatagaggggctg

SEQ ID NO: 28461 - DNA, 21 bp, synthetic construct
  source 1..21: mol_type = other DNA
tctgccacgtaatagaggggc

SEQ ID NO: 28462 - DNA, 20 bp, synthetic construct
  source 1..20: mol_type = other DNA
tccagcccctctattacgtg

SEQ ID NO: 28463 - DNA, 20 bp, synthetic construct
  source 1..20: mol_type = other DNA
ccacgtaatagaggggctgg

SEQ ID NO: 28464 - DNA, 20 bp, synthetic construct
  source 1..20: mol_type = other DNA
ccagcccctctattacgtgg

SEQ ID NO: 28465 - DNA, 20 bp, synthetic construct
  source 1..20: mol_type = other DNA
cacgtaatagaggggctgga

SEQ ID NO: 28466 - DNA, 20 bp, synthetic construct
  source 1..20: mol_type = other DNA
cagcccctctattacgtggc

SEQ ID NO: 28467 - DNA, 20 bp, synthetic construct
  source 1..20: mol_type = other DNA
cagcccctctattacgtggc

SEQ ID NO: 28468 - DNA, 20 bp, synthetic construct
  source 1..20: mol_type = other DNA
acgtaatagaggggctggaa

SEQ ID NO: 28469 - DNA, 23 bp, synthetic construct
  source 1..23: mol_type = other DNA
cggagttccagcccctctattac

SEQ ID NO: 28470 - DNA, 23 bp, synthetic construct
  source 1..23: mol_type = other DNA
cggagttccagcccctctattac

SEQ ID NO: 28471 - DNA, 23 bp, synthetic construct
  source 1..23: mol_type = other DNA
cggagttccagcccctctattac

SEQ ID NO: 28472 - DNA, 24 bp, synthetic construct
  source 1..24: mol_type = other DNA
tattacgtggcagagagttttaat

SEQ ID NO: 28473 - DNA, 20 bp, synthetic construct
  source 1..20: mol_type = other DNA
agcccctctattacgtggca

SEQ ID NO: 28474 - DNA, 20 bp, synthetic construct
  source 1..20: mol_type = other DNA
gttccagcccctctattacg

SEQ ID NO: 28475 - DNA, 20 bp, synthetic construct
  source 1..20: mol_type = other DNA
agcccctctattacgtggca

SEQ ID NO: 28476 - DNA, 20 bp, synthetic construct
  source 1..20: mol_type = other DNA
gcccctctattacgtggcag

SEQ ID NO: 28477 - DNA, 20 bp, synthetic construct
  source 1..20: mol_type = other DNA
cgtaatagaggggctggaac

SEQ ID NO: 28478 - DNA, 23 bp, synthetic construct
  source 1..23: mol_type = other DNA
cggagttccagcccctctattac

SEQ ID NO: 28479 - DNA, 23 bp, synthetic construct
  source 1..23: mol_type = other DNA
cggagttccagcccctctattac

SEQ ID NO: 28480 - DNA, 24 bp, synthetic construct
  source 1..24: mol_type = other DNA
tattacgtggcagagagttttaat

SEQ ID NO: 28481 - DNA, 21 bp, synthetic construct
  source 1..21: mol_type = other DNA
gagttccagcccctctattac

SEQ ID NO: 28482 - DNA, 21 bp, synthetic construct
  source 1..21: mol_type = other DNA
agcccctctattacgtggcag

SEQ ID NO: 28483 - DNA, 20 bp, synthetic construct
  source 1..20: mol_type = other DNA
cccctctattacgtggcaga

SEQ ID NO: 28484 - DNA, 20 bp, synthetic construct
  source 1..20: mol_type = other DNA
gcccctctattacgtggcag

SEQ ID NO: 28485 - DNA, 20 bp, synthetic construct
  source 1..20: mol_type = other DNA
gtaatagaggggctggaact

SEQ ID NO: 28486 - DNA, 23 bp, synthetic construct
  source 1..23: mol_type = other DNA
cgtaatagaggggctggaactcc

SEQ ID NO: 28487 - DNA, 23 bp, synthetic construct
  source 1..23: mol_type = other DNA
cggagttccagcccctctattac

SEQ ID NO: 28488 - DNA, 23 bp, synthetic construct
  source 1..23: mol_type = other DNA
cgtaatagaggggctggaactcc

SEQ ID NO: 28489 - DNA, 21 bp, synthetic construct
  source 1..21: mol_type = other DNA
cagcccctctattacgtggca

SEQ ID NO: 28490 - DNA, 21 bp, synthetic construct
  source 1..21: mol_type = other DNA
agcccctctattacgtggcag

SEQ ID NO: 28491 - DNA, 20 bp, synthetic construct
  source 1..20: mol_type = other DNA
cccctctattacgtggcaga

SEQ ID NO: 28492 - DNA, 20 bp, synthetic construct
  source 1..20: mol_type = other DNA
taatagaggggctggaactc

SEQ ID NO: 28493 - DNA, 21 bp, synthetic construct
  source 1..21: mol_type = other DNA
ctctattacgtggcagagagt

SEQ ID NO: 28494 - DNA, 20 bp, synthetic construct
  source 1..20: mol_type = other DNA
ccctctattacgtggcagag

SEQ ID NO: 28495 - DNA, 20 bp, synthetic construct
  source 1..20: mol_type = other DNA
ccctctattacgtggcagag

SEQ ID NO: 28496 - DNA, 20 bp, synthetic construct
  source 1..20: mol_type = other DNA
aatagaggggctggaactcc

SEQ ID NO: 28497 - DNA, 23 bp, synthetic construct
  source 1..23: mol_type = other DNA
cgtaatagaggggctggaactcc

SEQ ID NO: 28498 - DNA, 20 bp, synthetic construct
  source 1..20: mol_type = other DNA
cccctctattacgtggcaga

SEQ ID NO: 28499 - DNA, 20 bp, synthetic construct
  source 1..20: mol_type = other DNA
cctctattacgtggcagaga

SEQ ID NO: 28500 - DNA, 20 bp, synthetic construct
  source 1..20: mol_type = other DNA
atagaggggctggaactccg

SEQ ID NO: 28501 - DNA, 20 bp, synthetic construct
  source 1..20: mol_type = other DNA
ctctattacgtggcagagag

SEQ ID NO: 28502 - DNA, 20 bp, synthetic construct
  source 1..20: mol_type = other DNA
tagaggggctggaactccgt

SEQ ID NO: 28503 - DNA, 20 bp, synthetic construct
  source 1..20: mol_type = other DNA
tctattacgtggcagagagt

SEQ ID NO: 28504 - DNA, 20 bp, synthetic construct
  source 1..20: mol_type = other DNA
agaggggctggaactccgtg

SEQ ID NO: 28505 - DNA, 20 bp, synthetic construct
  source 1..20: mol_type = other DNA
gaggggctggaactccgtga

SEQ ID NO: 28506 - DNA, 20 bp, synthetic construct
  source 1..20: mol_type = other DNA
ctattacgtggcagagagtt

SEQ ID NO: 28507 - DNA, 20 bp, synthetic construct
  source 1..20: mol_type = other DNA
tacgtggcagagagttttaa

SEQ ID NO: 28508 - DNA, 20 bp, synthetic construct
  source 1..20: mol_type = other DNA
tattacgtggcagagagttt

SEQ ID NO: 28509 - DNA, 20 bp, synthetic construct
  source 1..20: mol_type = other DNA
aggggctggaactccgtgac

SEQ ID NO: 28510 - DNA, 23 bp, synthetic construct
  source 1..23: mol_type = other DNA
attacgtggcagagagttttaat

SEQ ID NO: 28511 - DNA, 23 bp, synthetic construct
  source 1..23: mol_type = other DNA
cgtaatagaggggctggaactcc

SEQ ID NO: 28512 - DNA, 23 bp, synthetic construct
  source 1..23: mol_type = other DNA
attacgtggcagagagttttaat

SEQ ID NO: 28513 - DNA, 23 bp, synthetic construct
  source 1..23: mol_type = other DNA
cgtaatagaggggctggaactcc

SEQ ID NO: 28514 - DNA, 21 bp, synthetic construct
  source 1..21: mol_type = other DNA
ggggctggaactccgtgacag

SEQ ID NO: 28515 - DNA, 20 bp, synthetic construct
  source 1..20: mol_type = other DNA
ttacgtggcagagagtttta

SEQ ID NO: 28516 - DNA, 20 bp, synthetic construct
  source 1..20: mol_type = other DNA
attacgtggcagagagtttt

SEQ ID NO: 28517 - DNA, 20 bp, synthetic construct
  source 1..20: mol_type = other DNA
ggggctggaactccgtgaca

SEQ ID NO: 28518 - DNA, 21 bp, synthetic construct
  source 1..21: mol_type = other DNA
ggcagagagttttaatgatgc

SEQ ID NO: 28519 - DNA, 20 bp, synthetic construct
  source 1..20: mol_type = other DNA
gggctggaactccgtgacag

SEQ ID NO: 28520 - DNA, 20 bp, synthetic construct
  source 1..20: mol_type = other DNA
ttacgtggcagagagtttta

SEQ ID NO: 28521 - DNA, 21 bp, synthetic construct
  source 1..21: mol_type = other DNA
tattacgtggcagagagtttt

SEQ ID NO: 28522 - DNA, 21 bp, synthetic construct
  source 1..21: mol_type = other DNA
tattacgtggcagagagtttt

SEQ ID NO: 28523 - DNA, 20 bp, synthetic construct
  source 1..20: mol_type = other DNA
tacgtggcagagagttttaa

SEQ ID NO: 28524 - DNA, 20 bp, synthetic construct
  source 1..20: mol_type = other DNA
tacgtggcagagagttttaa

SEQ ID NO: 28525 - DNA, 20 bp, synthetic construct
  source 1..20: mol_type = other DNA
ggctggaactccgtgacagt

SEQ ID NO: 28526 - DNA, 21 bp, synthetic construct
  source 1..21: mol_type = other DNA
ggggctggaactccgtgacag

SEQ ID NO: 28527 - DNA, 21 bp, synthetic construct
  source 1..21: mol_type = other DNA
ggggctggaactccgtgacag

SEQ ID NO: 28528 - DNA, 20 bp, synthetic construct
  source 1..20: mol_type = other DNA
cgtggcagagagttttaatg

SEQ ID NO: 28529 - DNA, 20 bp, synthetic construct
  source 1..20: mol_type = other DNA
acgtggcagagagttttaat

SEQ ID NO: 28530 - DNA, 20 bp, synthetic construct
  source 1..20: mol_type = other DNA
gctggaactccgtgacagtg

SEQ ID NO: 28531 - DNA, 21 bp, synthetic construct
  source 1..21: mol_type = other DNA
ggcagagagttttaatgatgc

SEQ ID NO: 28532 - DNA, 20 bp, synthetic construct
  source 1..20: mol_type = other DNA
gggctggaactccgtgacag

SEQ ID NO: 28533 - DNA, 20 bp, synthetic construct
  source 1..20: mol_type = other DNA
cgtggcagagagttttaatg

SEQ ID NO: 28534 - DNA, 20 bp, synthetic construct
  source 1..20: mol_type = other DNA
ctggaactccgtgacagtgt

SEQ ID NO: 28535 - DNA, 23 bp, synthetic construct
  source 1..23: mol_type = other DNA
ttacgtggcagagagttttaatg

SEQ ID NO: 28536 - DNA, 23 bp, synthetic construct
  source 1..23: mol_type = other DNA
ttacgtggcagagagttttaatg

SEQ ID NO: 28537 - DNA, 21 bp, synthetic construct
  source 1..21: mol_type = other DNA
gtggcagagagttttaatgat

SEQ ID NO: 28538 - DNA, 20 bp, synthetic construct
  source 1..20: mol_type = other DNA
aactccgtgacagtgtaatt

SEQ ID NO: 28539 - DNA, 20 bp, synthetic construct
  source 1..20: mol_type = other DNA
tggaactccgtgacagtgta

SEQ ID NO: 28540 - DNA, 20 bp, synthetic construct
  source 1..20: mol_type = other DNA
gtggcagagagttttaatga

SEQ ID NO: 28541 - DNA, 21 bp, synthetic construct
  source 1..21: mol_type = other DNA
gtggcagagagttttaatgat

SEQ ID NO: 28542 - DNA, 21 bp, synthetic construct
  source 1..21: mol_type = other DNA
ggaactccgtgacagtgtaat

SEQ ID NO: 28543 - DNA, 21 bp, synthetic construct
  source 1..21: mol_type = other DNA
ggaactccgtgacagtgtaat

SEQ ID NO: 28544 - DNA, 20 bp, synthetic construct
  source 1..20: mol_type = other DNA
actccgtgacagtgtaattt

SEQ ID NO: 28545 - DNA, 20 bp, synthetic construct
  source 1..20: mol_type = other DNA
tggcagagagttttaatgat

SEQ ID NO: 28546 - DNA, 20 bp, synthetic construct
  source 1..20: mol_type = other DNA
ggaactccgtgacagtgtaa

SEQ ID NO: 28547 - DNA, 20 bp, synthetic construct
  source 1..20: mol_type = other DNA
aactccgtgacagtgtaatt

SEQ ID NO: 28548 - DNA, 20 bp, synthetic construct
  source 1..20: mol_type = other DNA
gaactccgtgacagtgtaat

SEQ ID NO: 28549 - DNA, 20 bp, synthetic construct
  source 1..20: mol_type = other DNA
gtggcagagagttttaatga

SEQ ID NO: 28550 - DNA, 20 bp, synthetic construct
  source 1..20: mol_type = other DNA
ggcagagagttttaatgatg

SEQ ID NO: 28551 - DNA, 21 bp, synthetic construct
  source 1..21: mol_type = other DNA
gaactccgtgacagtgtaatt

SEQ ID NO: 28552 - DNA, 20 bp, synthetic construct
  source 1..20: mol_type = other DNA
cagagagttttaatgatgcc

SEQ ID NO: 28553 - DNA, 20 bp, synthetic construct
  source 1..20: mol_type = other DNA
gcagagagttttaatgatgc

SEQ ID NO: 28554 - DNA, 20 bp, synthetic construct
  source 1..20: mol_type = other DNA
aactccgtgacagtgtaatt

SEQ ID NO: 28555 - DNA, 21 bp, synthetic construct
  source 1..21: mol_type = other DNA
gcagagagttttaatgatgcc

SEQ ID NO: 28556 - DNA, 21 bp, synthetic construct
  source 1..21: mol_type = other DNA
gaactccgtgacagtgtaatt

SEQ ID NO: 28557 - DNA, 21 bp, synthetic construct
  source 1..21: mol_type = other DNA
gcagagagttttaatgatgcc

SEQ ID NO: 28558 - DNA, 21 bp, synthetic construct
  source 1..21: mol_type = other DNA
gaactccgtgacagtgtaatt

SEQ ID NO: 28559 - DNA, 20 bp, synthetic construct
  source 1..20: mol_type = other DNA
actccgtgacagtgtaattt

SEQ ID NO: 28560 - DNA, 20 bp, synthetic construct
  source 1..20: mol_type = other DNA
cagagagttttaatgatgcc

SEQ ID NO: 28561 - DNA, 20 bp, synthetic construct
  source 1..20: mol_type = other DNA
ctccgtgacagtgtaatttt

SEQ ID NO: 28562 - DNA, 20 bp, synthetic construct
  source 1..20: mol_type = other DNA
agagagttttaatgatgcca

SEQ ID NO: 28563 - DNA, 20 bp, synthetic construct
  source 1..20: mol_type = other DNA
gagagttttaatgatgccaa

SEQ ID NO: 28564 - DNA, 20 bp, synthetic construct
  source 1..20: mol_type = other DNA
tccgtgacagtgtaattttg

SEQ ID NO: 28565 - DNA, 23 bp, synthetic construct
  source 1..23: mol_type = other DNA
actccgtgacagtgtaattttgg

SEQ ID NO: 28566 - DNA, 23 bp, synthetic construct
  source 1..23: mol_type = other DNA
actccgtgacagtgtaattttgg

SEQ ID NO: 28567 - DNA, 21 bp, synthetic construct
  source 1..21: mol_type = other DNA
ctccgtgacagtgtaattttg

SEQ ID NO: 28568 - DNA, 20 bp, synthetic construct
  source 1..20: mol_type = other DNA
agagttttaatgatgccaag

SEQ ID NO: 28569 - DNA, 20 bp, synthetic construct
  source 1..20: mol_type = other DNA
ccgtgacagtgtaattttgg

SEQ ID NO: 28570 - DNA, 23 bp, synthetic construct
  source 1..23: mol_type = other DNA
ttacgtggcagagagttttaatg

SEQ ID NO: 28571 - DNA, 23 bp, synthetic construct
  source 1..23: mol_type = other DNA
ttacgtggcagagagttttaatg

SEQ ID NO: 28572-28720 - skipped (149 entries)

SEQ ID NO: 28721 - DNA, 20 bp, synthetic construct
  source 1..20: mol_type = other DNA
tcaccccgattccttctaca

SEQ ID NO: 28722 - DNA, 21 bp, synthetic construct
  source 1..21: mol_type = other DNA
gcatttgggctgtgatgtaga

SEQ ID NO: 28723 - DNA, 20 bp, synthetic construct
  source 1..20: mol_type = other DNA
cccgattccttctacatcac

SEQ ID NO: 28724 - DNA, 20 bp, synthetic construct
  source 1..20: mol_type = other DNA
atttgggctgtgatgtagaa

SEQ ID NO: 28725 - DNA, 20 bp, synthetic construct
  source 1..20: mol_type = other DNA
caccccgattccttctacat

SEQ ID NO: 28726 - DNA, 20 bp, synthetic construct
  source 1..20: mol_type = other DNA
tttgggctgtgatgtagaag

SEQ ID NO: 28727 - DNA, 20 bp, synthetic construct
  source 1..20: mol_type = other DNA
ccccgattccttctacatca

SEQ ID NO: 28728 - DNA, 20 bp, synthetic construct
  source 1..20: mol_type = other DNA
caaattactttgcacatact

SEQ ID NO: 28729 - DNA, 20 bp, synthetic construct
  source 1..20: mol_type = other DNA
accccgattccttctacatc

SEQ ID NO: 28730 - DNA, 20 bp, synthetic construct
  source 1..20: mol_type = other DNA
gggctgtgatgtagaaggaa

SEQ ID NO: 28731 - DNA, 20 bp, synthetic construct
  source 1..20: mol_type = other DNA
ttgggctgtgatgtagaagg

SEQ ID NO: 28732 - DNA, 20 bp, synthetic construct
  source 1..20: mol_type = other DNA
cccgattccttctacatcac

SEQ ID NO: 28733 - DNA, 23 bp, synthetic construct
  source 1..23: mol_type = other DNA
ctcaccccgattccttctacatc

SEQ ID NO: 28734 - DNA, 24 bp, synthetic construct
  source 1..24: mol_type = other DNA
ctcaccccgattccttctacatca

SEQ ID NO: 28735 - DNA, 21 bp, synthetic construct
  source 1..21: mol_type = other DNA
gccaaattactttgcacatac

SEQ ID NO: 28736 - DNA, 21 bp, synthetic construct
  source 1..21: mol_type = other DNA
caccccgattccttctacatc

SEQ ID NO: 28737 - DNA, 21 bp, synthetic construct
  source 1..21: mol_type = other DNA
tgggctgtgatgtagaaggaa

SEQ ID NO: 28738 - DNA, 20 bp, synthetic construct
  source 1..20: mol_type = other DNA
ccccgattccttctacatca

SEQ ID NO: 28739 - DNA, 20 bp, synthetic construct
  source 1..20: mol_type = other DNA
caaattactttgcacatact

SEQ ID NO: 28740 - DNA, 20 bp, synthetic construct
  source 1..20: mol_type = other DNA
ccccgattccttctacatca

SEQ ID NO: 28741 - DNA, 20 bp, synthetic construct
  source 1..20: mol_type = other DNA
cccgattccttctacatcac

SEQ ID NO: 28742 - DNA, 20 bp, synthetic construct
  source 1..20: mol_type = other DNA
tgggctgtgatgtagaagga

SEQ ID NO: 28743 - DNA, 23 bp, synthetic construct
  source 1..23: mol_type = other DNA
tcaccccgattccttctacatca

SEQ ID NO: 28744 - DNA, 23 bp, synthetic construct
  source 1..23: mol_type = other DNA
tcaccccgattccttctacatca

SEQ ID NO: 28745 - DNA, 23 bp, synthetic construct
  source 1..23: mol_type = other DNA
ttctacatcacagcccaaatgct

SEQ ID NO: 28746 - DNA, 21 bp, synthetic construct
  source 1..21: mol_type = other DNA
ccgattccttctacatcacag

SEQ ID NO: 28747 - DNA, 21 bp, synthetic construct
  source 1..21: mol_type = other DNA
tgggctgtgatgtagaaggaa

SEQ ID NO: 28748 - DNA, 21 bp, synthetic construct
  source 1..21: mol_type = other DNA
tgggctgtgatgtagaaggaa

SEQ ID NO: 28749 - DNA, 21 bp, synthetic construct
  source 1..21: mol_type = other DNA
gccaaattactttgcacatac

SEQ ID NO: 28750 - DNA, 21 bp, synthetic construct
  source 1..21: mol_type = other DNA
caccccgattccttctacatc

SEQ ID NO: 28751 - DNA, 20 bp, synthetic construct
  source 1..20: mol_type = other DNA
ccccgattccttctacatca

SEQ ID NO: 28752 - DNA, 20 bp, synthetic construct
  source 1..20: mol_type = other DNA
cccgattccttctacatcac

SEQ ID NO: 28753 - DNA, 20 bp, synthetic construct
  source 1..20: mol_type = other DNA
gggctgtgatgtagaaggaa

SEQ ID NO: 28754 - DNA, 21 bp, synthetic construct
  source 1..21: mol_type = other DNA
gggctgtgatgtagaaggaat

SEQ ID NO: 28755 - DNA, 21 bp, synthetic construct
  source 1..21: mol_type = other DNA
ccgattccttctacatcacag

SEQ ID NO: 28756 - DNA, 21 bp, synthetic construct
  source 1..21: mol_type = other DNA
caccccgattccttctacatc

SEQ ID NO: 28757 - DNA, 20 bp, synthetic construct
  source 1..20: mol_type = other DNA
ggctgtgatgtagaaggaat

SEQ ID NO: 28758 - DNA, 20 bp, synthetic construct
  source 1..20: mol_type = other DNA
ccgattccttctacatcaca

SEQ ID NO: 28759 - DNA, 21 bp, synthetic construct
  source 1..21: mol_type = other DNA
ccgattccttctacatcacag

SEQ ID NO: 28760 - DNA, 20 bp, synthetic construct
  source 1..20: mol_type = other DNA
gctgtgatgtagaaggaatc

SEQ ID NO: 28761 - DNA, 20 bp, synthetic construct
  source 1..20: mol_type = other DNA
cgattccttctacatcacag

SEQ ID NO: 28762 - DNA, 20 bp, synthetic construct
  source 1..20: mol_type = other DNA
ctgtgatgtagaaggaatcg

SEQ ID NO: 28763 - DNA, 20 bp, synthetic construct
  source 1..20: mol_type = other DNA
gattccttctacatcacagc

SEQ ID NO: 28764 - DNA, 20 bp, synthetic construct
  source 1..20: mol_type = other DNA
tgtgatgtagaaggaatcgg

SEQ ID NO: 28765 - DNA, 20 bp, synthetic construct
  source 1..20: mol_type = other DNA
tgtgatgtagaaggaatcgg

SEQ ID NO: 28766 - DNA, 20 bp, synthetic construct
  source 1..20: mol_type = other DNA
attccttctacatcacagcc

SEQ ID NO: 28767 - DNA, 23 bp, synthetic construct
  source 1..23: mol_type = other DNA
gcatttgggctgtgatgtagaag

SEQ ID NO: 28768 - DNA, 23 bp, synthetic construct
  source 1..23: mol_type = other DNA
gcatttgggctgtgatgtagaag

SEQ ID NO: 28769 - DNA, 23 bp, synthetic construct
  source 1..23: mol_type = other DNA
gcatttgggctgtgatgtagaag

SEQ ID NO: 28770 - DNA, 24 bp, synthetic construct
  source 1..24: mol_type = other DNA
ggtgagatgagagaaggggcacaa

SEQ ID NO: 28771 - DNA, 20 bp, synthetic construct
  source 1..20: mol_type = other DNA
gtgatgtagaaggaatcggg

SEQ ID NO: 28772 - DNA, 20 bp, synthetic construct
  source 1..20: mol_type = other DNA
ctgtgatgtagaaggaatcg

SEQ ID NO: 28773 - DNA, 20 bp, synthetic construct
  source 1..20: mol_type = other DNA
gtgatgtagaaggaatcggg

SEQ ID NO: 28774 - DNA, 20 bp, synthetic construct
  source 1..20: mol_type = other DNA
tgtgatgtagaaggaatcgg

SEQ ID NO: 28775 - DNA, 20 bp, synthetic construct
  source 1..20: mol_type = other DNA
ttccttctacatcacagccc

SEQ ID NO: 28776 - DNA, 23 bp, synthetic construct
  source 1..23: mol_type = other DNA
gcatttgggctgtgatgtagaag

SEQ ID NO: 28777 - DNA, 23 bp, synthetic construct
  source 1..23: mol_type = other DNA
gcatttgggctgtgatgtagaag

SEQ ID NO: 28778 - DNA, 24 bp, synthetic construct
  source 1..24: mol_type = other DNA
ggtgagatgagagaaggggcacaa

SEQ ID NO: 28779 - DNA, 21 bp, synthetic construct
  source 1..21: mol_type = other DNA
ggctgtgatgtagaaggaatc

SEQ ID NO: 28780 - DNA, 21 bp, synthetic construct
  source 1..21: mol_type = other DNA
gtgatgtagaaggaatcgggg

SEQ ID NO: 28781 - DNA, 20 bp, synthetic construct
  source 1..20: mol_type = other DNA
gtgatgtagaaggaatcggg

SEQ ID NO: 28782 - DNA, 20 bp, synthetic construct
  source 1..20: mol_type = other DNA
tgatgtagaaggaatcgggg

SEQ ID NO: 28783 - DNA, 20 bp, synthetic construct
  source 1..20: mol_type = other DNA
tccttctacatcacagccca

SEQ ID NO: 28784 - DNA, 23 bp, synthetic construct
  source 1..23: mol_type = other DNA
gattccttctacatcacagccca

SEQ ID NO: 28785 - DNA, 23 bp, synthetic construct
  source 1..23: mol_type = other DNA
gcatttgggctgtgatgtagaag

SEQ ID NO: 28786 - DNA, 23 bp, synthetic construct
  source 1..23: mol_type = other DNA
gattccttctacatcacagccca

SEQ ID NO: 28787 - DNA, 21 bp, synthetic construct
  source 1..21: mol_type = other DNA
gtgatgtagaaggaatcgggg

SEQ ID NO: 28788 - DNA, 21 bp, synthetic construct
  source 1..21: mol_type = other DNA
gtgatgtagaaggaatcgggg

SEQ ID NO: 28789 - DNA, 20 bp, synthetic construct
  source 1..20: mol_type = other DNA
gatgtagaaggaatcggggt

SEQ ID NO: 28790 - DNA, 20 bp, synthetic construct
  source 1..20: mol_type = other DNA
ccttctacatcacagcccaa

SEQ ID NO: 28791 - DNA, 21 bp, synthetic construct
  source 1..21: mol_type = other DNA
atgtagaaggaatcggggtga

SEQ ID NO: 28792 - DNA, 20 bp, synthetic construct
  source 1..20: mol_type = other DNA
atgtagaaggaatcggggtg

SEQ ID NO: 28793 - DNA, 20 bp, synthetic construct
  source 1..20: mol_type = other DNA
atgtagaaggaatcggggtg

SEQ ID NO: 28794 - DNA, 20 bp, synthetic construct
  source 1..20: mol_type = other DNA
cttctacatcacagcccaaa

SEQ ID NO: 28795 - DNA, 23 bp, synthetic construct
  source 1..23: mol_type = other DNA
gattccttctacatcacagccca

SEQ ID NO: 28796 - DNA, 20 bp, synthetic construct
  source 1..20: mol_type = other DNA
gtagaaggaatcggggtgag

SEQ ID NO: 28797 - DNA, 20 bp, synthetic construct
  source 1..20: mol_type = other DNA
tgtagaaggaatcggggtga

SEQ ID NO: 28798 - DNA, 20 bp, synthetic construct
  source 1..20: mol_type = other DNA
ttctacatcacagcccaaat

SEQ ID NO: 28799 - DNA, 20 bp, synthetic construct
  source 1..20: mol_type = other DNA
gtagaaggaatcggggtgag

SEQ ID NO: 28800 - DNA, 20 bp, synthetic construct
  source 1..20: mol_type = other DNA
tctacatcacagcccaaatg

SEQ ID NO: 28801 - DNA, 20 bp, synthetic construct
  source 1..20: mol_type = other DNA
tagaaggaatcggggtgaga

SEQ ID NO: 28802 - DNA, 20 bp, synthetic construct
  source 1..20: mol_type = other DNA
ctacatcacagcccaaatgc

SEQ ID NO: 28803 - DNA, 20 bp, synthetic construct
  source 1..20: mol_type = other DNA
tacatcacagcccaaatgct

SEQ ID NO: 28804 - DNA, 20 bp, synthetic construct
  source 1..20: mol_type = other DNA
agaaggaatcggggtgagat

SEQ ID NO: 28805 - DNA, 20 bp, synthetic construct
  source 1..20: mol_type = other DNA
gaaggaatcggggtgagatg

SEQ ID NO: 28806 - DNA, 20 bp, synthetic construct
  source 1..20: mol_type = other DNA
gaaggaatcggggtgagatg

SEQ ID NO: 28807 - DNA, 20 bp, synthetic construct
  source 1..20: mol_type = other DNA
acatcacagcccaaatgctg

SEQ ID NO: 28808 - DNA, 23 bp, synthetic construct
  source 1..23: mol_type = other DNA
ggaatcggggtgagatgagagaa

SEQ ID NO: 28809 - DNA, 23 bp, synthetic construct
  source 1..23: mol_type = other DNA
tctacatcacagcccaaatgctg

SEQ ID NO: 28810 - DNA, 23 bp, synthetic construct
  source 1..23: mol_type = other DNA
ggaatcggggtgagatgagagaa

SEQ ID NO: 28811 - DNA, 23 bp, synthetic construct
  source 1..23: mol_type = other DNA
tctacatcacagcccaaatgctg

SEQ ID NO: 28812 - DNA, 21 bp, synthetic construct
  source 1..21: mol_type = other DNA
atcacagcccaaatgctgtga

SEQ ID NO: 28813 - DNA, 20 bp, synthetic construct
  source 1..20: mol_type = other DNA
aaggaatcggggtgagatga

SEQ ID NO: 28814 - DNA, 20 bp, synthetic construct
  source 1..20: mol_type = other DNA
aaggaatcggggtgagatga

SEQ ID NO: 28815 - DNA, 20 bp, synthetic construct
  source 1..20: mol_type = other DNA
catcacagcccaaatgctgt

SEQ ID NO: 28816 - DNA, 21 bp, synthetic construct
  source 1..21: mol_type = other DNA
aggaatcggggtgagatgaga

SEQ ID NO: 28817 - DNA, 20 bp, synthetic construct
  source 1..20: mol_type = other DNA
atcacagcccaaatgctgtg

SEQ ID NO: 28818 - DNA, 20 bp, synthetic construct
  source 1..20: mol_type = other DNA
aggaatcggggtgagatgag

SEQ ID NO: 28819 - DNA, 21 bp, synthetic construct
  source 1..21: mol_type = other DNA
aggaatcggggtgagatgaga

SEQ ID NO: 28820 - DNA, 21 bp, synthetic construct
  source 1..21: mol_type = other DNA
aggaatcggggtgagatgaga

SEQ ID NO: 28821 - DNA, 20 bp, synthetic construct
  source 1..20: mol_type = other DNA
aggaatcggggtgagatgag

SEQ ID NO: 28822 - DNA, 20 bp, synthetic construct
  source 1..20: mol_type = other DNA
ggaatcggggtgagatgaga

SEQ ID NO: 28823 - DNA, 20 bp, synthetic construct
  source 1..20: mol_type = other DNA
tcacagcccaaatgctgtga

SEQ ID NO: 28824 - DNA, 21 bp, synthetic construct
  source 1..21: mol_type = other DNA
tcacagcccaaatgctgtgag

SEQ ID NO: 28825 - DNA, 21 bp, synthetic construct
  source 1..21: mol_type = other DNA
tcacagcccaaatgctgtgag

SEQ ID NO: 28826 - DNA, 20 bp, synthetic construct
  source 1..20: mol_type = other DNA
gaatcggggtgagatgagag

SEQ ID NO: 28827 - DNA, 20 bp, synthetic construct
  source 1..20: mol_type = other DNA
gaatcggggtgagatgagag

SEQ ID NO: 28828 - DNA, 20 bp, synthetic construct
  source 1..20: mol_type = other DNA
cacagcccaaatgctgtgag

SEQ ID NO: 28829 - DNA, 21 bp, synthetic construct
  source 1..21: mol_type = other DNA
gaatcggggtgagatgagaga

SEQ ID NO: 28830 - DNA, 20 bp, synthetic construct
  source 1..20: mol_type = other DNA
atcacagcccaaatgctgtg

SEQ ID NO: 28831 - DNA, 20 bp, synthetic construct
  source 1..20: mol_type = other DNA
aatcggggtgagatgagaga

SEQ ID NO: 28832 - DNA, 20 bp, synthetic construct
  source 1..20: mol_type = other DNA
acagcccaaatgctgtgagc

SEQ ID NO: 28833 - DNA, 23 bp, synthetic construct
  source 1..23: mol_type = other DNA
ggaatcggggtgagatgagagaa

SEQ ID NO: 28834 - DNA, 23 bp, synthetic construct
  source 1..23: mol_type = other DNA
ggaatcggggtgagatgagagaa

SEQ ID NO: 28835 - DNA, 21 bp, synthetic construct
  source 1..21: mol_type = other DNA
gaatcggggtgagatgagaga

SEQ ID NO: 28836 - DNA, 20 bp, synthetic construct
  source 1..20: mol_type = other DNA
catcacagcccaaatgctgt

SEQ ID NO: 28837 - DNA, 20 bp, synthetic construct
  source 1..20: mol_type = other DNA
cagcccaaatgctgtgagcc

SEQ ID NO: 28838 - DNA, 20 bp, synthetic construct
  source 1..20: mol_type = other DNA
atcggggtgagatgagagaa

SEQ ID NO: 28839 - DNA, 21 bp, synthetic construct
  source 1..21: mol_type = other DNA
gaatcggggtgagatgagaga

SEQ ID NO: 28840 - DNA, 21 bp, synthetic construct
  source 1..21: mol_type = other DNA
tcacagcccaaatgctgtgag

SEQ ID NO: 28841 - DNA, 21 bp, synthetic construct
  source 1..21: mol_type = other DNA
tcacagcccaaatgctgtgag

SEQ ID NO: 28842 - DNA, 20 bp, synthetic construct
  source 1..20: mol_type = other DNA
atcacagcccaaatgctgtg

SEQ ID NO: 28843 - DNA, 20 bp, synthetic construct
  source 1..20: mol_type = other DNA
tcggggtgagatgagagaag

SEQ ID NO: 28844 - DNA, 20 bp, synthetic construct
  source 1..20: mol_type = other DNA
agcccaaatgctgtgagcca

SEQ ID NO: 28845 - DNA, 20 bp, synthetic construct
  source 1..20: mol_type = other DNA
atgctgtgagccaaattact

SEQ ID NO: 28846 - DNA, 20 bp, synthetic construct
  source 1..20: mol_type = other DNA
gcccaaatgctgtgagccaa

SEQ ID NO: 28847 - DNA, 20 bp, synthetic construct
  source 1..20: mol_type = other DNA
cggggtgagatgagagaagg

SEQ ID NO: 28848 - DNA, 20 bp, synthetic construct
  source 1..20: mol_type = other DNA
cggggtgagatgagagaagg

SEQ ID NO: 28849 - DNA, 21 bp, synthetic construct
  source 1..21: mol_type = other DNA
tacatcacagcccaaatgctg

SEQ ID NO: 28850 - DNA, 20 bp, synthetic construct
  source 1..20: mol_type = other DNA
tcggggtgagatgagagaag

SEQ ID NO: 28851 - DNA, 20 bp, synthetic construct
  source 1..20: mol_type = other DNA
ggggtgagatgagagaaggg

SEQ ID NO: 28852 - DNA, 20 bp, synthetic construct
  source 1..20: mol_type = other DNA
cccaaatgctgtgagccaaa

SEQ ID NO: 28853 - DNA, 21 bp, synthetic construct
  source 1..21: mol_type = other DNA
ggggtgagatgagagaagggg

SEQ ID NO: 28854 - DNA, 21 bp, synthetic construct
  source 1..21: mol_type = other DNA
tcacagcccaaatgctgtgag

SEQ ID NO: 28855 - DNA, 21 bp, synthetic construct
  source 1..21: mol_type = other DNA
ggggtgagatgagagaagggg

SEQ ID NO: 28856 - DNA, 21 bp, synthetic construct
  source 1..21: mol_type = other DNA
tcacagcccaaatgctgtgag

SEQ ID NO: 28857 - DNA, 20 bp, synthetic construct
  source 1..20: mol_type = other DNA
ccaaatgctgtgagccaaat

SEQ ID NO: 28858 - DNA, 20 bp, synthetic construct
  source 1..20: mol_type = other DNA
gggtgagatgagagaagggg

SEQ ID NO: 28859 - DNA, 20 bp, synthetic construct
  source 1..20: mol_type = other DNA
caaatgctgtgagccaaatt

SEQ ID NO: 28860 - DNA, 20 bp, synthetic construct
  source 1..20: mol_type = other DNA
ggtgagatgagagaaggggc

SEQ ID NO: 28861 - DNA, 20 bp, synthetic construct
  source 1..20: mol_type = other DNA
gtgagatgagagaaggggca

SEQ ID NO: 28862 - DNA, 20 bp, synthetic construct
  source 1..20: mol_type = other DNA
aaatgctgtgagccaaatta

SEQ ID NO: 28863 - DNA, 23 bp, synthetic construct
  source 1..23: mol_type = other DNA
ccaaatgctgtgagccaaattac

SEQ ID NO: 28864 - DNA, 23 bp, synthetic construct
  source 1..23: mol_type = other DNA
ccaaatgctgtgagccaaattac

SEQ ID NO: 28865 - DNA, 21 bp, synthetic construct
  source 1..21: mol_type = other DNA
tcacagcccaaatgctgtgag

SEQ ID NO: 28866 - DNA, 20 bp, synthetic construct
  source 1..20: mol_type = other DNA
tgagatgagagaaggggcac

SEQ ID NO: 28867 - DNA, 20 bp, synthetic construct
  source 1..20: mol_type = other DNA
aatgctgtgagccaaattac

SEQ ID NO: 28868 - DNA, 23 bp, synthetic construct
  source 1..23: mol_type = other DNA
gtgagatgagagaaggggcacaa

SEQ ID NO: 28869 - DNA, 23 bp, synthetic construct
  source 1..23: mol_type = other DNA
gtgagatgagagaaggggcacaa

SEQ ID NO: 28870-29018 - skipped (149 entries)

SEQ ID NO: 29019 - DNA, 138 bp, synthetic construct
  source 1..138: mol_type = other DNA
ttgctgccacaataccttgggttttagagctagaaatagcaagttaaaataaggctagtccgttatcaacttgaaaaagtggcaccgagtcggtgcgtatgggtcgtagcgaactgagaagggccgaggtattgtggc

SEQ ID NO: 29020 - DNA, 138 bp, synthetic construct
  source 1..138: mol_type = other DNA
agcgaactgagaagggccaagttttagagctagaaatagcaagttaaaataaggctagtccgttatcaacttgaaaaagtggcaccgagtcggtgctcttaggaactttgctgccacaatacctcggcccttctcagt

SEQ ID NO: 29021 - DNA, 138 bp, synthetic construct; identical to SEQ ID NO: 29020
  source 1..138: mol_type = other DNA

SEQ ID NO: 29022 - DNA, 138 bp, synthetic construct
  source 1..138: mol_type = other DNA
tttgctgccacaataccttggttttagagctagaaatagcaagttaaaataaggctagtccgttatcaacttgaaaaagtggcaccgagtcggtgctatgggtcgtagcgaactgagaagggccgaggtattgtggca

SEQ ID NO: 29023 - DNA, 177 bp, synthetic construct
  source 1..177: mol_type = other DNA
gtcgtagcgaactgagaagggccagttgtagctccctttttcatttcgcgaaagcgaaatgaaaaacgttgttacaataagagatgaatttctcgcaaagctctgcctcttgaaatttcggtttcaagaggcatccttaggaactttgctgccacaatacctcggcccttctcagtt

SEQ ID NO: 29024 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcagtt

SEQ ID NO: 29025 - DNA, 138 bp, synthetic construct; identical to SEQ ID NO: 29024
  source 1..138: mol_type = other DNA

SEQ ID NO: 29026 - DNA, 138 bp, synthetic construct; identical to SEQ ID NO: 29024
  source 1..138: mol_type = other DNA

SEQ ID NO: 29027 - DNA, 138 bp, synthetic construct
  source 1..138: mol_type = other DNA
ctttgctgccacaataccttgttttagagctagaaatagcaagttaaaataaggctagtccgttatcaacttgaaaaagtggcaccgagtcggtgcatgggtcgtagcgaactgagaagggccgaggtattgtggcag

SEQ ID NO: 29028 - DNA, 138 bp, synthetic construct; identical to SEQ ID NO: 29024
  source 1..138: mol_type = other DNA

SEQ ID NO: 29029 - DNA, 138 bp, synthetic construct; identical to SEQ ID NO: 29027
  source 1..138: mol_type = other DNA

SEQ ID NO: 29030 - DNA, 212 bp, synthetic construct
  source 1..212: mol_type = other DNA
gaactttgctgccacaataccttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctatgggtcgtagcgaactgagaagggccgaggtattgtggcag

SEQ ID NO: 29031 - DNA, 187 bp, synthetic construct
  source 1..187: mol_type = other DNA
aggaactttgctgccacaatacctgttgtagctccctttctcatttcggaaacgaaatgagaaccgttgctacaataaggccgtctgaaaagatgtgccgcaacgctctgccccttaaagcttctgctttaaggggcatcgtttatgggtcgtagcgaactgagaagggccgaggtattgtggcagc

SEQ ID NO: 29032 - DNA, 139 bp, synthetic construct
  source 1..139: mol_type = other DNA
cgtagcgaactgagaagggccgttttagtactctggaaacagaatctactaaaacaaggcaaaatgccgtgtttatctcgtcaacttgttggcgagattaggaactttgctgccacaatacctcggcccttctcagttc

SEQ ID NO: 29033 - DNA, 139 bp, synthetic construct; identical to SEQ ID NO: 29032
  source 1..139: mol_type = other DNA

SEQ ID NO: 29034 - DNA, 138 bp, synthetic construct
  source 1..138: mol_type = other DNA
actttgctgccacaatacctgttttagagctagaaatagcaagttaaaataaggctagtccgttatcaacttgaaaaagtggcaccgagtcggtgctgggtcgtagcgaactgagaagggccgaggtattgtggcagc

SEQ ID NO: 29035 - DNA, 138 bp, synthetic construct; identical to SEQ ID NO: 29034
  source 1..138: mol_type = other DNA

SEQ ID NO: 29036 - DNA, 138 bp, synthetic construct; identical to SEQ ID NO: 29034
  source 1..138: mol_type = other DNA

SEQ ID NO: 29037 - DNA, 138 bp, synthetic construct
  source 1..138: mol_type = other DNA
gtagcgaactgagaagggccgttttagagctagaaatagcaagttaaaataaggctagtccgttatcaacttgaaaaagtggcaccgagtcggtgcttaggaactttgctgccacaatacctcggcccttctcagttc

SEQ ID NO: 29038 - DNA, 138 bp, synthetic construct; identical to SEQ ID NO: 29037
  source 1..138: mol_type = other DNA

SEQ ID NO: 29039 - DNA, 138 bp, synthetic construct; identical to SEQ ID NO: 29034
  source 1..138: mol_type = other DNA

SEQ ID NO: 29040 - DNA, 212 bp, synthetic construct
  source 1..212: mol_type = other DNA
ggaactttgctgccacaatacctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttgggtcgtagcgaactgagaagggccgaggtattgtggcagc

SEQ ID NO: 29041 - DNA, 212 bp, synthetic construct; identical to SEQ ID NO: 29040
  source 1..212: mol_type = other DNA

SEQ ID NO: 29042 - DNA, 187 bp, synthetic construct
  source 1..187: mol_type = other DNA
taggaactttgctgccacaataccgttgtagctccctttctcatttcggaaacgaaatgagaaccgttgctacaataaggccgtctgaaaagatgtgccgcaacgctctgccccttaaagcttctgctttaaggggcatcgtttagggtcgtagcgaactgagaagggccgaggtattgtggcagca

SEQ ID NO: 29043 - DNA, 139 bp, synthetic construct
  source 1..139: mol_type = other DNA
tcgtagcgaactgagaagggcgttttagtactctggaaacagaatctactaaaacaaggcaaaatgccgtgtttatctcgtcaacttgttggcgagataggaactttgctgccacaatacctcggcccttctcagttcg

SEQ ID NO: 29044 - DNA, 139 bp, synthetic construct; identical to SEQ ID NO: 29043
  source 1..139: mol_type = other DNA

SEQ ID NO: 29045 - DNA, 139 bp, synthetic construct
  source 1..139: mol_type = other DNA
gaactttgctgccacaataccgttttagtactctggaaacagaatctactaaaacaaggcaaaatgccgtgtttatctcgtcaacttgttggcgagagggtcgtagcgaactgagaagggccgaggtattgtggcagca

SEQ ID NO: 29046 - DNA, 139 bp, synthetic construct; identical to SEQ ID NO: 29045
  source 1..139: mol_type = other DNA

SEQ ID NO: 29047 - DNA, 139 bp, synthetic construct; identical to SEQ ID NO: 29043
  source 1..139: mol_type = other DNA

SEQ ID NO: 29048 - DNA, 138 bp, synthetic construct
  source 1..138: mol_type = other DNA
aactttgctgccacaataccgttttagagctagaaatagcaagttaaaataaggctagtccgttatcaacttgaaaaagtggcaccgagtcggtgcgggtcgtagcgaactgagaagggccgaggtattgtggcagca

SEQ ID NO: 29049 - DNA, 138 bp, synthetic construct; identical to SEQ ID NO: 29048
  source 1..138: mol_type = other DNA

SEQ ID NO: 29050 - DNA, 138 bp, synthetic construct
  source 1..138: mol_type = other DNA
cgtagcgaactgagaagggcgttttagagctagaaatagcaagttaaaataaggctagtccgttatcaacttgaaaaagtggcaccgagtcggtgctaggaactttgctgccacaatacctcggcccttctcagttcg

SEQ ID NO: 29051 - DNA, 212 bp, synthetic construct
  source 1..212: mol_type = other DNA
aggaactttgctgccacaataccgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgggtcgtagcgaactgagaagggccgaggtattgtggcagca

SEQ ID NO: 29052 - DNA, 139 bp, synthetic construct
  source 1..139: mol_type = other DNA
gtcgtagcgaactgagaaggggttttagtactctggaaacagaatctactaaaacaaggcaaaatgccgtgtttatctcgtcaacttgttggcgagaaggaactttgctgccacaatacctcggcccttctcagttcgc

SEQ ID NO: 29053 - DNA, 139 bp, synthetic construct
  source 1..139: mol_type = other DNA
ggaactttgctgccacaatacgttttagtactctggaaacagaatctactaaaacaaggcaaaatgccgtgtttatctcgtcaacttgttggcgagaggtcgtagcgaactgagaagggccgaggtattgtggcagcaa

SEQ ID NO: 29054 - DNA, 138 bp, synthetic construct
  source 1..138: mol_type = other DNA
tcgtagcgaactgagaaggggttttagagctagaaatagcaagttaaaataaggctagtccgttatcaacttgaaaaagtggcaccgagtcggtgcaggaactttgctgccacaatacctcggcccttctcagttcgc

SEQ ID NO: 29055 - DNA, 138 bp, synthetic construct
  source 1..138: mol_type = other DNA
gaactttgctgccacaatacgttttagagctagaaatagcaagttaaaataaggctagtccgttatcaacttgaaaaagtggcaccgagtcggtgcggtcgtagcgaactgagaagggccgaggtattgtggcagcaa

SEQ ID NO: 29056 - DNA, 139 bp, synthetic construct
  source 1..139: mol_type = other DNA
ggtcgtagcgaactgagaagggttttagtactctggaaacagaatctactaaaacaaggcaaaatgccgtgtttatctcgtcaacttgttggcgagaggaactttgctgccacaatacctcggcccttctcagttcgct

SEQ ID NO: 29057 - DNA, 138 bp, synthetic construct
  source 1..138: mol_type = other DNA
gtcgtagcgaactgagaagggttttagagctagaaatagcaagttaaaataaggctagtccgttatcaacttgaaaaagtggcaccgagtcggtgcggaactttgctgccacaatacctcggcccttctcagttcgct

SEQ ID NO: 29058 - DNA, 138 bp, synthetic construct
  source 1..138: mol_type = other DNA
ggaactttgctgccacaatagttttagagctagaaatagcaagttaaaataaggctagtccgttatcaacttgaaaaagtggcaccgagtcggtgcgtcgtagcgaactgagaagggccgaggtattgtggcagcaaa

SEQ ID NO: 29059 - DNA, 138 bp, synthetic construct
  source 1..138: mol_type = other DNA
ggtcgtagcgaactgagaaggttttagagctagaaatagcaagttaaaataaggctagtccgttatcaacttgaaaaagtggcaccgagtcggtgcgaactttgctgccacaatacctcggcccttctcagttcgcta

SEQ ID NO: 29060 - DNA, 138 bp, synthetic construct; identical to SEQ ID NO: 29059
  source 1..138: mol_type = other DNA

SEQ ID NO: 29061 - DNA, 138 bp, synthetic construct
  source 1..138: mol_type = other DNA
aggaactttgctgccacaatgttttagagctagaaatagcaagttaaaataaggctagtccgttatcaacttgaaaaagtggcaccgagtcggtgctcgtagcgaactgagaagggccgaggtattgtggcagcaaag

SEQ ID NO: 29062 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgctac

SEQ ID NO: 29063 - DNA, 138 bp, synthetic construct; identical to SEQ ID NO: 29062
  source 1..138: mol_type = other DNA

SEQ ID NO: 29064 - DNA, 138 bp, synthetic construct; identical to SEQ ID NO: 29062
  source 1..138: mol_type = other DNA

SEQ ID NO: 29065 - DNA, 138 bp, synthetic construct; identical to SEQ ID NO: 29062
  source 1..138: mol_type = other DNA

SEQ ID NO: 29066 - DNA, 138 bp, synthetic construct
  source 1..138: mol_type = other DNA
taggaactttgctgccacaagttttagagctagaaatagcaagttaaaataaggctagtccgttatcaacttgaaaaagtggcaccgagtcggtgccgtagcgaactgagaagggccgaggtattgtggcagcaaagt

SEQ ID NO: 29067 - DNA, 212 bp, synthetic construct
  source 1..212: mol_type = other DNA
tatgggtcgtagcgaactgagaagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctaactttgctgccacaatacctcggcccttctcagttcgctac

SEQ ID NO: 29068 - DNA, 212 bp, synthetic construct; identical to SEQ ID NO: 29067
  source 1..212: mol_type = other DNA

SEQ ID NO: 29069 - DNA, 187 bp, synthetic construct
  source 1..187: mol_type = other DNA
tgtatgggtcgtagcgaactgagagttgtagctccctttctcatttcggaaacgaaatgagaaccgttgctacaataaggccgtctgaaaagatgtgccgcaacgctctgccccttaaagcttctgctttaaggggcatcgtttaactttgctgccacaatacctcggcccttctcagttcgctacg

SEQ ID NO: 29070 - DNA, 139 bp, synthetic construct
  source 1..139: mol_type = other DNA
atgggtcgtagcgaactgagagttttagtactctggaaacagaatctactaaaacaaggcaaaatgccgtgtttatctcgtcaacttgttggcgagaactttgctgccacaatacctcggcccttctcagttcgctacg

SEQ ID NO: 29071 - DNA, 139 bp, synthetic construct; identical to SEQ ID NO: 29070
  source 1..139: mol_type = other DNA

SEQ ID NO: 29072 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgctacg

SEQ ID NO: 29073 - DNA, 138 bp, synthetic construct; identical to SEQ ID NO: 29072
  source 1..138: mol_type = other DNA

SEQ ID NO: 29074 - DNA, 138 bp, synthetic construct; identical to SEQ ID NO: 29072
  source 1..138: mol_type = other DNA

SEQ ID NO: 29075 - DNA, 138 bp, synthetic construct; identical to SEQ ID NO: 29072
  source 1..138: mol_type = other DNA

SEQ ID NO: 29076 - DNA, 138 bp, synthetic construct
  source 1..138: mol_type = other DNA
ttaggaactttgctgccacagttttagagctagaaatagcaagttaaaataaggctagtccgttatcaacttgaaaaagtggcaccgagtcggtgcgtagcgaactgagaagggccgaggtattgtggcagcaaagtt

SEQ ID NO: 29077 - DNA, 212 bp, synthetic construct
  source 1..212: mol_type = other DNA
gtatgggtcgtagcgaactgagagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctactttgctgccacaatacctcggcccttctcagttcgctacg

SEQ ID NO: 29078 - DNA, 212 bp, synthetic construct; identical to SEQ ID NO: 29077
  source 1..212: mol_type = other DNA

SEQ ID NO: 29079 - DNA, 212 bp, synthetic construct
  source 1..212: mol_type = other DNA
gtcttaggaactttgctgccacagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgtagcgaactgagaagggccgaggtattgtggcagcaaagtt

SEQ ID NO: 29080 - DNA, 212 bp, synthetic construct; identical to SEQ ID NO: 29077
  source 1..212: mol_type = other DNA

SEQ ID NO: 29081 - DNA, 212 bp, synthetic construct; identical to SEQ ID NO: 29079
  source 1..212: mol_type = other DNA

SEQ ID NO: 29082 - DNA, 187 bp, synthetic construct
  source 1..187: mol_type = other DNA
tggtcttaggaactttgctgccacgttgtagctccctttctcatttcggaaacgaaatgagaaccgttgctacaataaggccgtctgaaaagatgtgccgcaacgctctgccccttaaagcttctgctttaaggggcatcgtttatagcgaactgagaagggccgaggtattgtggcagcaaagttc

SEQ ID NO: 29083 - DNA, 141 bp, synthetic construct
  source 1..141: mol_type = other DNA
tgtatgggtcgtagcgaactgaggttttagtactctggaaacagaatctactaaaacaaggcaaaatgccgtgtttatctcgtcaacttgttggcgagactttgctgccacaatacctcggcccttctcagttcgctacga

SEQ ID NO: 29084 - DNA, 139 bp, synthetic construct
  source 1..139: mol_type = other DNA
tatgggtcgtagcgaactgaggttttagtactctggaaacagaatctactaaaacaaggcaaaatgccgtgtttatctcgtcaacttgttggcgagactttgctgccacaatacctcggcccttctcagttcgctacga

SEQ ID NO: 29085 - DNA, 139 bp, synthetic construct; identical to SEQ ID NO: 29084
  source 1..139: mol_type = other DNA

SEQ ID NO: 29086 - DNA, 139 bp, synthetic construct; identical to SEQ ID NO: 29084
  source 1..139: mol_type = other DNA

SEQ ID NO: 29087 - DNA, 138 bp, synthetic construct
  source 1..138: mol_type = other DNA
atgggtcgtagcgaactgaggttttagagctagaaatagcaagttaaaataaggctagtccgttatcaacttgaaaaagtggcaccgagtcggtgcctttgctgccacaatacctcggcccttctcagttcgctacga

SEQ ID NO: 29088 - DNA, 138 bp, synthetic construct; identical to SEQ ID NO: 29087
  source 1..138: mol_type = other DNA

SEQ ID NO: 29089 - DNA, 138 bp, synthetic construct
  source 1..138: mol_type = other DNA
cttaggaactttgctgccacgttttagagctagaaatagcaagttaaaataaggctagtccgttatcaacttgaaaaagtggcaccgagtcggtgctagcgaactgagaagggccgaggtattgtggcagcaaagttc

SEQ ID NO: 29090 - DNA, 212 bp, synthetic construct
  source 1..212: mol_type = other DNA
ggtcttaggaactttgctgccacgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttagcgaactgagaagggccgaggtattgtggcagcaaagttc

SEQ ID NO: 29091 - DNA, 212 bp, synthetic construct; identical to SEQ ID NO: 29090
  source 1..212: mol_type = other DNA

SEQ ID NO: 29092 - DNA, 139 bp, synthetic construct
  source 1..139: mol_type = other DNA
gtatgggtcgtagcgaactgagttttagtactctggaaacagaatctactaaaacaaggcaaaatgccgtgtttatctcgtcaacttgttggcgagatttgctgccacaatacctcggcccttctcagttcgctacgac

SEQ ID NO: 29093 - DNA, 139 bp, synthetic construct; identical to SEQ ID NO: 29092
  source 1..139: mol_type = other DNA

SEQ ID NO: 29094 - DNA, 138 bp, synthetic construct
  source 1..138: mol_type = other DNA
tatgggtcgtagcgaactgagttttagagctagaaatagcaagttaaaataaggctagtccgttatcaacttgaaaaagtggcaccgagtcggtgctttgctgccacaatacctcggcccttctcagttcgctacgac

SEQ ID NO: 29095 - DNA, 138 bp, synthetic construct
  source 1..138: mol_type = other DNA
tcttaggaactttgctgccagttttagagctagaaatagcaagttaaaataaggctagtccgttatcaacttgaaaaagtggcaccgagtcggtgcagcgaactgagaagggccgaggtattgtggcagcaaagttcc

SEQ ID NO: 29096 - DNA, 139 bp, synthetic construct
  source 1..139: mol_type = other DNA
tgtatgggtcgtagcgaactggttttagtactctggaaacagaatctactaaaacaaggcaaaatgccgtgtttatctcgtcaacttgttggcgagattgctgccacaatacctcggcccttctcagttcgctacgacc

SEQ ID NO: 29097 - DNA, 138 bp, synthetic construct
  source 1..138: mol_type = other DNA
gtatgggtcgtagcgaactggttttagagctagaaatagcaagttaaaataaggctagtccgttatcaacttgaaaaagtggcaccgagtcggtgcttgctgccacaatacctcggcccttctcagttcgctacgacc

SEQ ID NO: 29098 - DNA, 138 bp, synthetic construct; identical to SEQ ID NO: 29097
  source 1..138: mol_type = other DNA

SEQ ID NO: 29099 - DNA, 138 bp, synthetic construct
  source 1..138: mol_type = other DNA
gtcttaggaactttgctgccgttttagagctagaaatagcaagttaaaataaggctagtccgttatcaacttgaaaaagtggcaccgagtcggtgcgcgaactgagaagggccgaggtattgtggcagcaaagttcct

SEQ ID NO: 29100 - DNA, 141 bp, synthetic construct
  source 1..141: mol_type = other DNA
gggtgtatgggtcgtagcgaactgttttagtactctggaaacagaatctactaaaacaaggcaaaatgccgtgtttatctcgtcaacttgttggcgagatgctgccacaatacctcggcccttctcagttcgctacgaccc

SEQ ID NO: 29101 - DNA, 139 bp, synthetic construct
  source 1..139: mol_type = other DNA
gtgtatgggtcgtagcgaactgttttagtactctggaaacagaatctactaaaacaaggcaaaatgccgtgtttatctcgtcaacttgttggcgagatgctgccacaatacctcggcccttctcagttcgctacgaccc

SEQ ID NO: 29102 - DNA, 139 bp, synthetic construct
  source 1..139: mol_type = other DNA
tggtcttaggaactttgctgcgttttagtactctggaaacagaatctactaaaacaaggcaaaatgccgtgtttatctcgtcaacttgttggcgagacgaactgagaagggccgaggtattgtggcagcaaagttccta

SEQ ID NO: 29103 - DNA, 139 bp, synthetic construct; identical to SEQ ID NO: 29102
  source 1..139: mol_type = other DNA

SEQ ID NO: 29104 - DNA, 138 bp, synthetic construct
  source 1..138: mol_type = other DNA
tgtatgggtcgtagcgaactgttttagagctagaaatagcaagttaaaataaggctagtccgttatcaacttgaaaaagtggcaccgagtcggtgctgctgccacaatacctcggcccttctcagttcgctacgaccc

SEQ ID NO: 29105 - DNA, 138 bp, synthetic construct; identical to SEQ ID NO: 29104
  source 1..138: mol_type = other DNA

SEQ ID NO: 29106 - DNA, 138 bp, synthetic construct
  source 1..138: mol_type = other DNA
ggtcttaggaactttgctgcgttttagagctagaaatagcaagttaaaataaggctagtccgttatcaacttgaaaaagtggcaccgagtcggtgccgaactgagaagggccgaggtattgtggcagcaaagttccta

SEQ ID NO: 29107 - DNA, 139 bp, synthetic construct
  source 1..139: mol_type = other DNA
ggtgtatgggtcgtagcgaacgttttagtactctggaaacagaatctactaaaacaaggcaaaatgccgtgtttatctcgtcaacttgttggcgagagctgccacaatacctcggcccttctcagttcgctacgaccca

SEQ ID NO: 29108 - DNA, 139 bp, synthetic construct; identical to SEQ ID NO: 29107
  source 1..139: mol_type = other DNA

SEQ ID NO: 29109 - DNA, 138 bp, synthetic construct
  source 1..138: mol_type = other DNA
gtgtatgggtcgtagcgaacgttttagagctagaaatagcaagttaaaataaggctagtccgttatcaacttgaaaaagtggcaccgagtcggtgcgctgccacaatacctcggcccttctcagttcgctacgaccca

SEQ ID NO: 29110 - DNA, 138 bp, synthetic construct; identical to SEQ ID NO: 29109
  source 1..138: mol_type = other DNA

SEQ ID NO: 29111 - DNA, 138 bp, synthetic construct
  source 1..138: mol_type = other DNA
tggtcttaggaactttgctggttttagagctagaaatagcaagttaaaataaggctagtccgttatcaacttgaaaaagtggcaccgagtcggtgcgaactgagaagggccgaggtattgtggcagcaaagttcctaa

SEQ ID NO: 29112 - DNA, 141 bp, synthetic construct
  source 1..141: mol_type = other DNA
ttgggtgtatgggtcgtagcgaagttttagtactctggaaacagaatctactaaaacaaggcaaaatgccgtgtttatctcgtcaacttgttggcgagactgccacaatacctcggcccttctcagttcgctacgacccat

SEQ ID NO: 29113 - DNA, 139 bp, synthetic construct
  source 1..139: mol_type = other DNA
gggtgtatgggtcgtagcgaagttttagtactctggaaacagaatctactaaaacaaggcaaaatgccgtgtttatctcgtcaacttgttggcgagactgccacaatacctcggcccttctcagttcgctacgacccat

SEQ ID NO: 29114 - DNA, 138 bp, synthetic construct
  source 1..138: mol_type = other DNA
ggtgtatgggtcgtagcgaagttttagagctagaaatagcaagttaaaataaggctagtccgttatcaacttgaaaaagtggcaccgagtcggtgcctgccacaatacctcggcccttctcagttcgctacgacccat

SEQ ID NO: 29115 - DNA, 138 bp, synthetic construct; identical to SEQ ID NO: 29114
  source 1..138: mol_type = other DNA

SEQ ID NO: 29116 - DNA, 138 bp, synthetic construct
  source 1..138: mol_type = other DNA
ttggtcttaggaactttgctgttttagagctagaaatagcaagttaaaataaggctagtccgttatcaacttgaaaaagtggcaccgagtcggtgcaactgagaagggccgaggtattgtggcagcaaagttcctaag

SEQ ID NO: 29117 - DNA, 212 bp, synthetic construct
  source 1..212: mol_type = other DNA
gttttggtcttaggaactttgctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctaactgagaagggccgaggtattgtggcagcaaagttcctaag

SEQ ID NO: 29118 - DNA, 212 bp, synthetic construct; identical to SEQ ID NO: 29117
  source 1..212: mol_type = other DNA

SEQ ID NO: 29119 - DNA, 139 bp, synthetic construct
  source 1..139: mol_type = other DNA
tgggtgtatgggtcgtagcgagttttagtactctggaaacagaatctactaaaacaaggcaaaatgccgtgtttatctcgtcaacttgttggcgagatgccacaatacctcggcccttctcagttcgctacgacccata

SEQ ID NO: 29120 - DNA, 138 bp, synthetic construct
  source 1..138: mol_type = other DNA
tttggtcttaggaactttgcgttttagagctagaaatagcaagttaaaataaggctagtccgttatcaacttgaaaaagtggcaccgagtcggtgcactgagaagggccgaggtattgtggcagcaaagttcctaaga

SEQ ID NO: 29121 - DNA, 138 bp, synthetic construct; identical to SEQ ID NO: 29120
  source 1..138: mol_type = other DNA

SEQ ID NO: 29122 - DNA, 138 bp, synthetic construct
  source 1..138: mol_type = other DNA
gggtgtatgggtcgtagcgagttttagagctagaaatagcaagttaaaataaggctagtccgttatcaacttgaaaaagtggcaccgagtcggtgctgccacaatacctcggcccttctcagttcgctacgacccata

SEQ ID NO: 29123 - DNA, 138 bp, synthetic construct
  source 1..138: mol_type = other DNA
ttttggtcttaggaactttggttttagagctagaaatagcaagttaaaataaggctagtccgttatcaacttgaaaaagtggcaccgagtcggtgcctgagaagggccgaggtattgtggcagcaaagttcctaagac

SEQ ID NO: 29124 - DNA, 138 bp, synthetic construct; identical to SEQ ID NO: 29123
  source 1..138: mol_type = other DNA

SEQ ID NO: 29125 - DNA, 138 bp, synthetic construct
  source 1..138: mol_type = other DNA
tgggtgtatgggtcgtagcggttttagagctagaaatagcaagttaaaataaggctagtccgttatcaacttgaaaaagtggcaccgagtcggtgcgccacaatacctcggcccttctcagttcgctacgacccatac

SEQ ID NO: 29126 - DNA, 212 bp, synthetic construct
  source 1..212: mol_type = other DNA
tggttttggtcttaggaactttggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctctgagaagggccgaggtattgtggcagcaaagttcctaagac

SEQ ID NO: 29127 - DNA, 187 bp, synthetic construct
  source 1..187: mol_type = other DNA
tgtggttttggtcttaggaactttgttgtagctccctttctcatttcggaaacgaaatgagaaccgttgctacaataaggccgtctgaaaagatgtgccgcaacgctctgccccttaaagcttctgctttaaggggcatcgtttatgagaagggccgaggtattgtggcagcaaagttcctaagacc

SEQ ID NO: 29128 - DNA, 138 bp, synthetic construct
  source 1..138: mol_type = other DNA
ttgggtgtatgggtcgtagcgttttagagctagaaatagcaagttaaaataaggctagtccgttatcaacttgaaaaagtggcaccgagtcggtgcccacaatacctcggcccttctcagttcgctacgacccataca

SEQ ID NO: 29129 - DNA, 138 bp, synthetic construct
  source 1..138: mol_type = other DNA
gttttggtcttaggaactttgttttagagctagaaatagcaagttaaaataaggctagtccgttatcaacttgaaaaagtggcaccgagtcggtgctgagaagggccgaggtattgtggcagcaaagttcctaagacc

SEQ ID NO: 29130 - DNA, 212 bp, synthetic construct
  source 1..212: mol_type = other DNA
gtggttttggtcttaggaactttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttgagaagggccgaggtattgtggcagcaaagttcctaagacc

SEQ ID NO: 29131 - DNA, 138 bp, synthetic construct
  source 1..138: mol_type = other DNA
tttgggtgtatgggtcgtaggttttagagctagaaatagcaagttaaaataaggctagtccgttatcaacttgaaaaagtggcaccgagtcggtgccacaatacctcggcccttctcagttcgctacgacccatacac

SEQ ID NO: 29132 - DNA, 138 bp, synthetic construct
  source 1..138: mol_type = other DNA
ggttttggtcttaggaacttgttttagagctagaaatagcaagttaaaataaggctagtccgttatcaacttgaaaaagtggcaccgagtcggtgcgagaagggccgaggtattgtggcagcaaagttcctaagacca

SEQ ID NO: 29133 - DNA, 138 bp, synthetic construct; identical to SEQ ID NO: 29131
  source 1..138: mol_type = other DNA

SEQ ID NO: 29134 - DNA, 138 bp, synthetic construct; identical to SEQ ID NO: 29132
  source 1..138: mol_type = other DNA

SEQ ID NO: 29135 - DNA, 212 bp, synthetic construct
  source 1..212: mol_type = other DNA
tcctttgggtgtatgggtcgtaggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcacaatacctcggcccttctcagttcgctacgacccatacac

SEQ ID NO: 29136 - DNA, 212 bp, synthetic construct; identical to SEQ ID NO: 29135
  source 1..212: mol_type = other DNA

SEQ ID NO: 29137 - DNA, 141 bp, synthetic construct
  source 1..141: mol_type = other DNA
atcctttgggtgtatgggtcgtagttttagtactctggaaacagaatctactaaaacaaggcaaaatgccgtgtttatctcgtcaacttgttggcgagaacaatacctcggcccttctcagttcgctacgacccatacacc

SEQ ID NO: 29138 - DNA, 139 bp, synthetic construct
  source 1..139: mol_type = other DNA
cctttgggtgtatgggtcgtagttttagtactctggaaacagaatctactaaaacaaggcaaaatgccgtgtttatctcgtcaacttgttggcgagaacaatacctcggcccttctcagttcgctacgacccatacacc

SEQ ID NO: 29139 - DNA, 138 bp, synthetic construct
  source 1..138: mol_type = other DNA
ctttgggtgtatgggtcgtagttttagagctagaaatagcaagttaaaataaggctagtccgttatcaacttgaaaaagtggcaccgagtcggtgcacaatacctcggcccttctcagttcgctacgacccatacacc

SEQ ID NO: 29140 - DNA, 138 bp, synthetic construct; identical to SEQ ID NO: 29139
  source 1..138: mol_type = other DNA

SEQ ID NO: 29141 - DNA, 138 bp, synthetic construct
  source 1..138: mol_type = other DNA
tggttttggtcttaggaactgttttagagctagaaatagcaagttaaaataaggctagtccgttatcaacttgaaaaagtggcaccgagtcggtgcagaagggccgaggtattgtggcagcaaagttcctaagaccaa

SEQ ID NO: 29142 - DNA, 138 bp, synthetic construct; identical to SEQ ID NO: 29141
  source 1..138: mol_type = other DNA

SEQ ID NO: 29143 - DNA, 139 bp, synthetic construct
  source 1..139: mol_type = other DNA
tcctttgggtgtatgggtcgtgttttagtactctggaaacagaatctactaaaacaaggcaaaatgccgtgtttatctcgtcaacttgttggcgagacaatacctcggcccttctcagttcgctacgacccatacaccc

SEQ ID NO: 29144 - DNA, 138 bp, synthetic construct
  source 1..138: mol_type = other DNA
cctttgggtgtatgggtcgtgttttagagctagaaatagcaagttaaaataaggctagtccgttatcaacttgaaaaagtggcaccgagtcggtgccaatacctcggcccttctcagttcgctacgacccatacaccc

SEQ ID NO: 29145 - DNA, 138 bp, synthetic construct; identical to SEQ ID NO: 29144
  source 1..138: mol_type = other DNA

SEQ ID NO: 29146 - DNA, 138 bp, synthetic construct
  source 1..138: mol_type = other DNA
gtggttttggtcttaggaacgttttagagctagaaatagcaagttaaaataaggctagtccgttatcaacttgaaaaagtggcaccgagtcggtgcgaagggccgaggtattgtggcagcaaagttcctaagaccaaa

SEQ ID NO: 29147 - DNA, 212 bp, synthetic construct
  source 1..212: mol_type = other DNA
cctgtggttttggtcttaggaacgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgaagggccgaggtattgtggcagcaaagttcctaagaccaaa

SEQ ID NO: 29148 - DNA, 138 bp, synthetic construct
  source 1..138: mol_type = other DNA
tcctttgggtgtatgggtcggttttagagctagaaatagcaagttaaaataaggctagtccgttatcaacttgaaaaagtggcaccgagtcggtgcaatacctcggcccttctcagttcgctacgacccatacaccca

SEQ ID NO: 29149 - DNA, 138 bp, synthetic construct; identical to SEQ ID NO: 29148
  source 1..138: mol_type = other DNA

SEQ ID NO: 29150 - DNA, 138 bp, synthetic construct
  source 1..138: mol_type = other DNA
tgtggttttggtcttaggaagttttagagctagaaatagcaagttaaaataaggctagtccgttatcaacttgaaaaagtggcaccgagtcggtgcaagggccgaggtattgtggcagcaaagttcctaagaccaaaa

SEQ ID NO: 29151 - DNA, 139 bp, synthetic construct
  source 1..139: mol_type = other DNA
aatcctttgggtgtatgggtcgttttagtactctggaaacagaatctactaaaacaaggcaaaatgccgtgtttatctcgtcaacttgttggcgagaatacctcggcccttctcagttcgctacgacccatacacccaa

SEQ ID NO: 29152 - DNA, 138 bp, synthetic construct
  source 1..138: mol_type = other DNA
atcctttgggtgtatgggtcgttttagagctagaaatagcaagttaaaataaggctagtccgttatcaacttgaaaaagtggcaccgagtcggtgcatacctcggcccttctcagttcgctacgacccatacacccaa

SEQ ID NO: 29153 - DNA, 138 bp, synthetic construct
  source 1..138: mol_type = other DNA
ctgtggttttggtcttaggagttttagagctagaaatagcaagttaaaataaggctagtccgttatcaacttgaaaaagtggcaccgagtcggtgcagggccgaggtattgtggcagcaaagttcctaagaccaaaac

SEQ ID NO: 29154 - DNA, 212 bp, synthetic construct
  source 1..212: mol_type = other DNA
tcaatcctttgggtgtatgggtcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctatacctcggcccttctcagttcgctacgacccatacacccaa

SEQ ID NO: 29155 - DNA, 212 bp, synthetic construct; identical to SEQ ID NO: 29154
  source 1..212: mol_type = other DNA

SEQ ID NO: 29156 - DNA, 212 bp, synthetic construct; identical to SEQ ID NO: 29154
  source 1..212: mol_type = other DNA

SEQ ID NO: 29157 - DNA, 139 bp, synthetic construct
  source 1..139: mol_type = other DNA
caatcctttgggtgtatgggtgttttagtactctggaaacagaatctactaaaacaaggcaaaatgccgtgtttatctcgtcaacttgttggcgagatacctcggcccttctcagttcgctacgacccatacacccaaa

SEQ ID NO: 29158 - DNA, 138 bp, synthetic construct
  source 1..138: mol_type = other DNA
aatcctttgggtgtatgggtgttttagagctagaaatagcaagttaaaataaggctagtccgttatcaacttgaaaaagtggcaccgagtcggtgctacctcggcccttctcagttcgctacgacccatacacccaaa

SEQ ID NO: 29159 - DNA, 138 bp, synthetic construct; identical to SEQ ID NO: 29158
  source 1..138: mol_type = other DNA

SEQ ID NO: 29160 - DNA, 138 bp, synthetic construct
  source 1..138: mol_type = other DNA
cctgtggttttggtcttagggttttagagctagaaatagcaagttaaaataaggctagtccgttatcaacttgaaaaagtggcaccgagtcggtgcgggccgaggtattgtggcagcaaagttcctaagaccaaaacc

SEQ ID NO: 29161 - DNA, 138 bp, synthetic construct
  source 1..138: mol_type = other DNA
caatcctttgggtgtatggggttttagagctagaaatagcaagttaaaataaggctagtccgttatcaacttgaaaaagtggcaccgagtcggtgcacctcggcccttctcagttcgctacgacccatacacccaaag

SEQ ID NO: 29162 - DNA, 138 bp, synthetic construct; identical to SEQ ID NO: 29161
  source 1..138: mol_type = other DNA

SEQ ID NO: 29163 - DNA, 138 bp, synthetic construct
  source 1..138: mol_type = other DNA
gcctgtggttttggtcttaggttttagagctagaaatagcaagttaaaataaggctagtccgttatcaacttgaaaaagtggcaccgagtcggtgcggccgaggtattgtggcagcaaagttcctaagaccaaaacca

SEQ ID NO: 29164 - DNA, 138 bp, synthetic construct
  source 1..138: mol_type = other DNA
agcctgtggttttggtcttagttttagagctagaaatagcaagttaaaataaggctagtccgttatcaacttgaaaaagtggcaccgagtcggtgcgccgaggtattgtggcagcaaagttcctaagaccaaaaccac

SEQ ID NO: 29165 - DNA, 138 bp, synthetic construct; identical to SEQ ID NO: 29164
  source 1..138: mol_type = other DNA

SEQ ID NO: 29166 - DNA, 138 bp, synthetic construct
  source 1..138: mol_type = other DNA
tcaatcctttgggtgtatgggttttagagctagaaatagcaagttaaaataaggctagtccgttatcaacttgaaaaagtggcaccgagtcggtgccctcggcccttctcagttcgctacgacccatacacccaaagg

SEQ ID NO: 29167 - DNA, 212 bp, synthetic construct
  source 1..212: mol_type = other DNA
tcaagcctgtggttttggtcttagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgccgaggtattgtggcagcaaagttcctaagaccaaaaccac

SEQ ID NO: 29168 - DNA, 212 bp, synthetic construct; identical to SEQ ID NO: 29167
  source 1..212: mol_type = other DNA

SEQ ID NO: 29169 - DNA, 141 bp, synthetic construct
  source 1..141: mol_type = other DNA
ctcaagcctgtggttttggtcttgttttagtactctggaaacagaatctactaaaacaaggcaaaatgccgtgtttatctcgtcaacttgttggcgagaccgaggtattgtggcagcaaagttcctaagaccaaaaccaca

SEQ ID NO: 29170 - DNA, 139 bp, synthetic construct
  source 1..139: mol_type = other DNA
caagcctgtggttttggtcttgttttagtactctggaaacagaatctactaaaacaaggcaaaatgccgtgtttatctcgtcaacttgttggcgagaccgaggtattgtggcagcaaagttcctaagaccaaaaccaca

SEQ ID NO: 29171 - DNA, 138 bp, synthetic construct
  source 1..138: mol_type = other DNA
aagcctgtggttttggtcttgttttagagctagaaatagcaagttaaaataaggctagtccgttatcaacttgaaaaagtggcaccgagtcggtgcccgaggtattgtggcagcaaagttcctaagaccaaaaccaca

SEQ ID NO: 29172 - DNA, 138 bp, synthetic construct; identical to SEQ ID NO: 29171
  source 1..138: mol_type = other DNA

SEQ ID NO: 29173 - DNA, 138 bp, synthetic construct; identical to SEQ ID NO: 29171
  source 1..138: mol_type = other DNA

SEQ ID NO: 29174 - DNA, 138 bp, synthetic construct
  source 1..138: mol_type = other DNA
ctcaatcctttgggtgtatggttttagagctagaaatagcaagttaaaataaggctagtccgttatcaacttgaaaaagtggcaccgagtcggtgcctcggcccttctcagttcgctacgacccatacacccaaagga

SEQ ID NO: 29175 - DNA, 138 bp, synthetic construct; identical to SEQ ID NO: 29171
  source 1..138: mol_type = other DNA

SEQ ID NO: 29176 - DNA, 138 bp, synthetic construct; identical to SEQ ID NO: 29174
  source 1..138: mol_type = other DNA

SEQ ID NO: 29177 - DNA, 141 bp, synthetic construct
  source 1..141: mol_type = other DNA
actcaagcctgtggttttggtctgttttagtactctggaaacagaatctactaaaacaaggcaaaatgccgtgtttatctcgtcaacttgttggcgagacgaggtattgtggcagcaaagttcctaagaccaaaaccacag

SEQ ID NO: 29178 - DNA, 139 bp, synthetic construct
  source 1..139: mol_type = other DNA
tcaagcctgtggttttggtctgttttagtactctggaaacagaatctactaaaacaaggcaaaatgccgtgtttatctcgtcaacttgttggcgagacgaggtattgtggcagcaaagttcctaagaccaaaaccacag

SEQ ID NO: 29179 - DNA, 139 bp, synthetic construct; identical to SEQ ID NO: 29178
  source 1..139: mol_type = other DNA

SEQ ID NO: 29180 - DNA, 139 bp, synthetic construct; identical to SEQ ID NO: 29178
  source 1..139: mol_type = other DNA

SEQ ID NO: 29181 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaaggat

SEQ ID NO: 29182 - DNA, 138 bp, synthetic construct; identical to SEQ ID NO: 29181
  source 1..138: mol_type = other DNA

SEQ ID NO: 29183 - DNA, 138 bp, synthetic construct; identical to SEQ ID NO: 29181
  source 1..138: mol_type = other DNA

SEQ ID NO: 29184 - DNA, 138 bp, synthetic construct
  source 1..138: mol_type = other DNA
caagcctgtggttttggtctgttttagagctagaaatagcaagttaaaataaggctagtccgttatcaacttgaaaaagtggcaccgagtcggtgccgaggtattgtggcagcaaagttcctaagaccaaaaccacag

SEQ ID NO: 29185 - DNA, 138 bp, synthetic construct; identical to SEQ ID NO: 29184
  source 1..138: mol_type = other DNA

SEQ ID NO: 29186 - DNA, 138 bp, synthetic construct; identical to SEQ ID NO: 29181
  source 1..138: mol_type = other DNA

SEQ ID NO: 29187 - DNA, 212 bp, synthetic construct
  source 1..212: mol_type = other DNA
agacctcaatcctttgggtgtatgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttcggcccttctcagttcgctacgacccatacacccaaaggat

SEQ ID NO: 29188 - DNA, 212 bp, synthetic construct; identical to SEQ ID NO: 29187
  source 1..212: mol_type = other DNA

SEQ ID NO: 29189 - DNA, 139 bp, synthetic construct
  source 1..139: mol_type = other DNA
ctcaagcctgtggttttggtcgttttagtactctggaaacagaatctactaaaacaaggcaaaatgccgtgtttatctcgtcaacttgttggcgagagaggtattgtggcagcaaagttcctaagaccaaaaccacagg

SEQ ID NO: 29190 - DNA, 139 bp, synthetic construct
  source 1..139: mol_type = other DNA
gacctcaatcctttgggtgtagttttagtactctggaaacagaatctactaaaacaaggcaaaatgccgtgtttatctcgtcaacttgttggcgagacggcccttctcagttcgctacgacccatacacccaaaggatt

SEQ ID NO: 29191 - DNA, 139 bp, synthetic construct; identical to SEQ ID NO: 29190
  source 1..139: mol_type = other DNA

SEQ ID NO: 29192 - DNA, 139 bp, synthetic construct; identical to SEQ ID NO: 29189
  source 1..139: mol_type = other DNA

SEQ ID NO: 29193 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaaggatt

SEQ ID NO: 29194 - DNA, 138 bp, synthetic construct; identical to SEQ ID NO: 29193
  source 1..138: mol_type = other DNA

SEQ ID NO: 29195 - DNA, 138 bp, synthetic construct; identical to SEQ ID NO: 29193
  source 1..138: mol_type = other DNA

SEQ ID NO: 29196 - DNA, 138 bp, synthetic construct; identical to SEQ ID NO: 29193
  source 1..138: mol_type = other DNA

SEQ ID NO: 29197 - DNA, 138 bp, synthetic construct
  source 1..138: mol_type = other DNA
tcaagcctgtggttttggtcgttttagagctagaaatagcaagttaaaataaggctagtccgttatcaacttgaaaaagtggcaccgagtcggtgcgaggtattgtggcagcaaagttcctaagaccaaaaccacagg

SEQ ID NO: 29198 - DNA, 146 bp, synthetic construct
  source 1..146: mol_type = other DNA
tcaagcctgtggttttggtcgtctttgtactctggtaccagaagctacaaagataaggcttcatgccgaaatcaacaccctgtcattttatggcagggtgttttgaggtattgtggcagcaaagttcctaagaccaaaaccacagg

SEQ ID NO: 29199 - DNA, 141 bp, synthetic construct
  source 1..141: mol_type = other DNA
caagacctcaatcctttgggtgtgttttagtactctggaaacagaatctactaaaacaaggcaaaatgccgtgtttatctcgtcaacttgttggcgagaggcccttctcagttcgctacgacccatacacccaaaggattg

SEQ ID NO: 29200 - DNA, 139 bp, synthetic construct
  source 1..139: mol_type = other DNA
agacctcaatcctttgggtgtgttttagtactctggaaacagaatctactaaaacaaggcaaaatgccgtgtttatctcgtcaacttgttggcgagaggcccttctcagttcgctacgacccatacacccaaaggattg

SEQ ID NO: 29201 - DNA, 141 bp, synthetic construct; identical to SEQ ID NO: 29199
  source 1..141: mol_type = other DNA

SEQ ID NO: 29202 - DNA, 139 bp, synthetic construct; identical to SEQ ID NO: 29200
  source 1..139: mol_type = other DNA

SEQ ID NO: 29203 - DNA, 139 bp, synthetic construct
  source 1..139: mol_type = other DNA
actcaagcctgtggttttggtgttttagtactctggaaacagaatctactaaaacaaggcaaaatgccgtgtttatctcgtcaacttgttggcgagaaggtattgtggcagcaaagttcctaagaccaaaaccacaggc

SEQ ID NO: 29204 - DNA, 139 bp, synthetic construct; identical to SEQ ID NO: 29200
  source 1..139: mol_type = other DNA

SEQ ID NO: 29205 - DNA, 139 bp, synthetic construct; identical to SEQ ID NO: 29200
  source 1..139: mol_type = other DNA

SEQ ID NO: 29206 - DNA, 138 bp, synthetic construct
  source 1..138: mol_type = other DNA
gacctcaatcctttgggtgtgttttagagctagaaatagcaagttaaaataaggctagtccgttatcaacttgaaaaagtggcaccgagtcggtgcggcccttctcagttcgctacgacccatacacccaaaggattg

SEQ ID NO: 29207 - DNA, 138 bp, synthetic construct; identical to SEQ ID NO: 29206
  source 1..138: mol_type = other DNA

SEQ ID NO: 29208 - DNA, 138 bp, synthetic construct
  source 1..138: mol_type = other DNA
ctcaagcctgtggttttggtgttttagagctagaaatagcaagttaaaataaggctagtccgttatcaacttgaaaaagtggcaccgagtcggtgcaggtattgtggcagcaaagttcctaagaccaaaaccacaggc

SEQ ID NO: 29209 - DNA, 96 bp, synthetic construct
  source 1..96: mol_type = other DNA
ctcgtaaggtgtaaattactgttttagagctagaaatagcaagttaaaataaggctagtccgttatcaacttgaaaaagtggcaccgagtcggtgc

SEQ ID NO: 29210 - DNA, 96 bp, synthetic construct
  source 1..96: mol_type = other DNA
ttcctaaaaaagaagtaaaagttttagagctagaaatagcaagttaaaataaggctagtccgttatcaacttgaaaaagtggcaccgagtcggtgc

SEQ ID NO: 29211 - DNA, 96 bp, synthetic construct
  source 1..96: mol_type = other DNA
cctaaaaaagaagtaaaatggttttagagctagaaatagcaagttaaaataaggctagtccgttatcaacttgaaaaagtggcaccgagtcggtgc

SEQ ID NO: 29212 - DNA, 96 bp, synthetic construct
  source 1..96: mol_type = other DNA
tcgtaaggtgtaaattacttgttttagagctagaaatagcaagttaaaataaggctagtccgttatcaacttgaaaaagtggcaccgagtcggtgc

SEQ ID NO: 29213 - DNA, 135 bp, synthetic construct
  source 1..135: mol_type = other DNA
gaagaccctgctctagggaggtgtgttgtagctccctttttcatttcgcgaaagcgaaatgaaaaacgttgttacaataagagatgaatttctcgcaaagctctgcctcttgaaatttcggtttcaagaggcatc

SEQ ID NO: 29214 - DNA, 96 bp, synthetic construct
  source 1..96: mol_type = other DNA
aaaaaagaagtaaaatgccagttttagagctagaaatagcaagttaaaataaggctagtccgttatcaacttgaaaaagtggcaccgagtcggtgc

SEQ ID NO: 29215 - DNA, 96 bp, synthetic construct
  source 1..96: mol_type = other DNA
ttgaagaccctgctctaggggttttagagctagaaatagcaagttaaaataaggctagtccgttatcaacttgaaaaagtggcaccgagtcggtgc

SEQ ID NO: 29216 - DNA, 96 bp, synthetic construct
  source 1..96: mol_type = other DNA
ctaaaaaagaagtaaaatgcgttttagagctagaaatagcaagttaaaataaggctagtccgttatcaacttgaaaaagtggcaccgagtcggtgc

SEQ ID NO: 29217 - DNA, 96 bp, synthetic construct
  source 1..96: mol_type = other DNA
gtaaggtgtaaattacttacgttttagagctagaaatagcaagttaaaataaggctagtccgttatcaacttgaaaaagtggcaccgagtcggtgc

SEQ ID NO: 29218 - DNA, 96 bp, synthetic construct
  source 1..96: mol_type = other DNA
aaaaagaagtaaaatgccacgttttagagctagaaatagcaagttaaaataaggctagtccgttatcaacttgaaaaagtggcaccgagtcggtgc

SEQ ID NO: 29219 - DNA, 96 bp, synthetic construct
  source 1..96: mol_type = other DNA
cgtaaggtgtaaattacttagttttagagctagaaatagcaagttaaaataaggctagtccgttatcaacttgaaaaagtggcaccgagtcggtgc

SEQ ID NO: 29220 - DNA, 170 bp, synthetic construct
  source 1..170: mol_type = other DNA
gtggcctcgtaaggtgtaaattagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29221 - DNA, 145 bp, synthetic construct
  source 1..145: mol_type = other DNA
gtaaattacttactgttaatggaagttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 29222 - DNA, 97 bp, synthetic construct
  source 1..97: mol_type = other DNA
cttaagactacctttctccaagttttagtactctggaaacagaatctactaaaacaaggcaaaatgccgtgtttatctcgtcaacttgttggcgaga

SEQ ID NO: 29223 - DNA, 97 bp, synthetic construct
  source 1..97: mol_type = other DNA
aaaaaagaagtaaaatgccacgttttagtactctggaaacagaatctactaaaacaaggcaaaatgccgtgtttatctcgtcaacttgttggcgaga

SEQ ID NO: 29224 - DNA, 96 bp, synthetic construct; identical to SEQ ID NO: 29219
  source 1..96: mol_type = other DNA

SEQ ID NO: 29225 - DNA, 96 bp, synthetic construct
  source 1..96: mol_type = other DNA
tgtaaattacttactgttaagttttagagctagaaatagcaagttaaaataaggctagtccgttatcaacttgaaaaagtggcaccgagtcggtgc

SEQ ID NO: 29226 - DNA, 96 bp, synthetic construct; identical to SEQ ID NO: 29217
  source 1..96: mol_type = other DNA

SEQ ID NO: 29227 - DNA, 96 bp, synthetic construct; identical to SEQ ID NO: 29214
  source 1..96: mol_type = other DNA

SEQ ID NO: 29228 - DNA, 96 bp, synthetic construct
  source 1..96: mol_type = other DNA
taaaaaagaagtaaaatgccgttttagagctagaaatagcaagttaaaataaggctagtccgttatcaacttgaaaaagtggcaccgagtcggtgc

SEQ ID NO: 29229 - DNA, 96 bp, synthetic construct; identical to SEQ ID NO: 29217
  source 1..96: mol_type = other DNA

SEQ ID NO: 29230 - DNA, 170 bp, synthetic construct; identical to SEQ ID NO: 29220
  source 1..170: mol_type = other DNA

SEQ ID NO: 29231 - DNA, 170 bp, synthetic construct; identical to SEQ ID NO: 29220
  source 1..170: mol_type = other DNA

SEQ ID NO: 29232 - DNA, 145 bp, synthetic construct; identical to SEQ ID NO: 29221
  source 1..145: mol_type = other DNA

SEQ ID NO: 29233 - DNA, 97 bp, synthetic construct
  source 1..97: mol_type = other DNA
taaaaaagaagtaaaatgccagttttagtactctggaaacagaatctactaaaacaaggcaaaatgccgtgtttatctcgtcaacttgttggcgaga

SEQ ID NO: 29234 - DNA, 97 bp, synthetic construct; identical to SEQ ID NO: 29233
  source 1..97: mol_type = other DNA

SEQ ID NO: 29235 - DNA, 97 bp, synthetic construct
  source 1..97: mol_type = other DNA
ggtgtaaattacttactgttagttttagtactctggaaacagaatctactaaaacaaggcaaaatgccgtgtttatctcgtcaacttgttggcgaga

SEQ ID NO: 29236 - DNA, 97 bp, synthetic construct; identical to SEQ ID NO: 29235
  source 1..97: mol_type = other DNA

SEQ ID NO: 29237 - DNA, 97 bp, synthetic construct; identical to SEQ ID NO: 29223
  source 1..97: mol_type = other DNA

SEQ ID NO: 29238 - DNA, 96 bp, synthetic construct; identical to SEQ ID NO: 29219
  source 1..96: mol_type = other DNA

SEQ ID NO: 29239 - DNA, 96 bp, synthetic construct
  source 1..96: mol_type = other DNA
taaggtgtaaattacttactgttttagagctagaaatagcaagttaaaataaggctagtccgttatcaacttgaaaaagtggcaccgagtcggtgc

SEQ ID NO: 29240 - DNA, 96 bp, synthetic construct; identical to SEQ ID NO: 29214
  source 1..96: mol_type = other DNA

SEQ ID NO: 29241 - DNA, 170 bp, synthetic construct; identical to SEQ ID NO: 29220
  source 1..170: mol_type = other DNA

SEQ ID NO: 29242 - DNA, 97 bp, synthetic construct; identical to SEQ ID NO: 29223
  source 1..97: mol_type = other DNA

SEQ ID NO: 29243 - DNA, 97 bp, synthetic construct
  source 1..97: mol_type = other DNA
gtaaggtgtaaattacttactgttttagtactctggaaacagaatctactaaaacaaggcaaaatgccgtgtttatctcgtcaacttgttggcgaga

SEQ ID NO: 29244 - DNA, 96 bp, synthetic construct; identical to SEQ ID NO: 29218
  source 1..96: mol_type = other DNA

SEQ ID NO: 29245 - DNA, 96 bp, synthetic construct
  source 1..96: mol_type = other DNA
aaggtgtaaattacttactggttttagagctagaaatagcaagttaaaataaggctagtccgttatcaacttgaaaaagtggcaccgagtcggtgc

SEQ ID NO: 29246 - DNA, 97 bp, synthetic construct
  source 1..97: mol_type = other DNA
aaaaagaagtaaaatgccactgttttagtactctggaaacagaatctactaaaacaaggcaaaatgccgtgtttatctcgtcaacttgttggcgaga

SEQ ID NO: 29247 - DNA, 96 bp, synthetic construct
  source 1..96: mol_type = other DNA
aaaagaagtaaaatgccactgttttagagctagaaatagcaagttaaaataaggctagtccgttatcaacttgaaaaagtggcaccgagtcggtgc

SEQ ID NO: 29248 - DNA, 96 bp, synthetic construct
  source 1..96: mol_type = other DNA
aggtgtaaattacttactgtgttttagagctagaaatagcaagttaaaataaggctagtccgttatcaacttgaaaaagtggcaccgagtcggtgc

SEQ ID NO: 29249 - DNA, 96 bp, synthetic construct
  source 1..96: mol_type = other DNA
aaagaagtaaaatgccactggttttagagctagaaatagcaagttaaaataaggctagtccgttatcaacttgaaaaagtggcaccgagtcggtgc

SEQ ID NO: 29250 - DNA, 96 bp, synthetic construct; identical to SEQ ID NO: 29249
  source 1..96: mol_type = other DNA

SEQ ID NO: 29251 - DNA, 96 bp, synthetic construct
  source 1..96: mol_type = other DNA
ggtgtaaattacttactgttgttttagagctagaaatagcaagttaaaataaggctagtccgttatcaacttgaaaaagtggcaccgagtcggtgc

SEQ ID NO: 29252 - DNA, 96 bp, synthetic construct; identical to SEQ ID NO: 29247
  source 1..96: mol_type = other DNA

SEQ ID NO: 29253 - DNA, 96 bp, synthetic construct
  source 1..96: mol_type = other DNA
taagactacctttctccaaagttttagagctagaaatagcaagttaaaataaggctagtccgttatcaacttgaaaaagtggcaccgagtcggtgc

SEQ ID NO: 29254 - DNA, 96 bp, synthetic construct
  source 1..96: mol_type = other DNA
aagaagtaaaatgccactgagttttagagctagaaatagcaagttaaaataaggctagtccgttatcaacttgaaaaagtggcaccgagtcggtgc

SEQ ID NO: 29255 - DNA, 96 bp, synthetic construct; identical to SEQ ID NO: 29249
  source 1..96: mol_type = other DNA

SEQ ID NO: 29256 - DNA, 96 bp, synthetic construct
  source 1..96: mol_type = other DNA
gtgtaaattacttactgttagttttagagctagaaatagcaagttaaaataaggctagtccgttatcaacttgaaaaagtggcaccgagtcggtgc

SEQ ID NO: 29257 - DNA, 170 bp, synthetic construct
  source 1..170: mol_type = other DNA
aaaaaagaagtaaaatgccactggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29258 - DNA, 170 bp, synthetic construct; identical to SEQ ID NO: 29257
  source 1..170: mol_type = other DNA

SEQ ID NO: 29259 - DNA, 145 bp, synthetic construct
  source 1..145: mol_type = other DNA
tccgtgttcctaaaaaagaagtaagttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 29260 - DNA, 97 bp, synthetic construct; identical to SEQ ID NO: 29222
  source 1..97: mol_type = other DNA

SEQ ID NO: 29261 - DNA, 97 bp, synthetic construct; identical to SEQ ID NO: 29223
  source 1..97: mol_type = other DNA

SEQ ID NO: 29262 - DNA, 96 bp, synthetic construct; identical to SEQ ID NO: 29247
  source 1..96: mol_type = other DNA

SEQ ID NO: 29263 - DNA, 96 bp, synthetic construct; identical to SEQ ID NO: 29253
  source 1..96: mol_type = other DNA

SEQ ID NO: 29264 - DNA, 96 bp, synthetic construct
  source 1..96: mol_type = other DNA
agaagtaaaatgccactgaggttttagagctagaaatagcaagttaaaataaggctagtccgttatcaacttgaaaaagtggcaccgagtcggtgc

SEQ ID NO: 29265 - DNA, 96 bp, synthetic construct; identical to SEQ ID NO: 29249
  source 1..96: mol_type = other DNA

SEQ ID NO: 29266 - DNA, 96 bp, synthetic construct; identical to SEQ ID NO: 29225
  source 1..96: mol_type = other DNA

SEQ ID NO: 29267 - DNA, 170 bp, synthetic construct
  source 1..170: mol_type = other DNA
aaaagaagtaaaatgccactgaggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29268 - DNA, 170 bp, synthetic construct; identical to SEQ ID NO: 29267
  source 1..170: mol_type = other DNA

SEQ ID NO: 29269 - DNA, 170 bp, synthetic construct
  source 1..170: mol_type = other DNA
gtgtaaattacttactgttaatggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29270 - DNA, 170 bp, synthetic construct; identical to SEQ ID NO: 29267
  source 1..170: mol_type = other DNA

SEQ ID NO: 29271 - DNA, 170 bp, synthetic construct; identical to SEQ ID NO: 29269
  source 1..170: mol_type = other DNA

SEQ ID NO: 29272 - DNA, 145 bp, synthetic construct; identical to SEQ ID NO: 29221
  source 1..145: mol_type = other DNA

SEQ ID NO: 29273 - DNA, 99 bp, synthetic construct
  source 1..99: mol_type = other DNA
taaaaaagaagtaaaatgccactgttttagtactctggaaacagaatctactaaaacaaggcaaaatgccgtgtttatctcgtcaacttgttggcgaga

SEQ ID NO: 29274 - DNA, 97 bp, synthetic construct; identical to SEQ ID NO: 29246
  source 1..97: mol_type = other DNA

SEQ ID NO: 29275 - DNA, 97 bp, synthetic construct; identical to SEQ ID NO: 29222
  source 1..97: mol_type = other DNA

SEQ ID NO: 29276 - DNA, 97 bp, synthetic construct; identical to SEQ ID NO: 29223
  source 1..97: mol_type = other DNA

SEQ ID NO: 29277 - DNA, 96 bp, synthetic construct; identical to SEQ ID NO: 29247
  source 1..96: mol_type = other DNA

SEQ ID NO: 29278 - DNA, 96 bp, synthetic construct
  source 1..96: mol_type = other DNA
gaagtaaaatgccactgagagttttagagctagaaatagcaagttaaaataaggctagtccgttatcaacttgaaaaagtggcaccgagtcggtgc

SEQ ID NO: 29279 - DNA, 96 bp, synthetic construct
  source 1..96: mol_type = other DNA
gtaaattacttactgttaatgttttagagctagaaatagcaagttaaaataaggctagtccgttatcaacttgaaaaagtggcaccgagtcggtgc

SEQ ID NO: 29280 - DNA, 170 bp, synthetic construct; identical to SEQ ID NO: 29269
  source 1..170: mol_type = other DNA

SEQ ID NO: 29281 - DNA, 170 bp, synthetic construct; identical to SEQ ID NO: 29269
  source 1..170: mol_type = other DNA

SEQ ID NO: 29282 - DNA, 97 bp, synthetic construct
  source 1..97: mol_type = other DNA
taaaatgccactgagaactctgttttagtactctggaaacagaatctactaaaacaaggcaaaatgccgtgtttatctcgtcaacttgttggcgaga

SEQ ID NO: 29283 - DNA, 97 bp, synthetic construct
  source 1..97: mol_type = other DNA
aaatgccactgagaactctctgttttagtactctggaaacagaatctactaaaacaaggcaaaatgccgtgtttatctcgtcaacttgttggcgaga

SEQ ID NO: 29284 - DNA, 96 bp, synthetic construct
  source 1..96: mol_type = other DNA
aagtaaaatgccactgagaagttttagagctagaaatagcaagttaaaataaggctagtccgttatcaacttgaaaaagtggcaccgagtcggtgc

SEQ ID NO: 29285 - DNA, 96 bp, synthetic construct
  source 1..96: mol_type = other DNA
taaattacttactgttaatggttttagagctagaaatagcaagttaaaataaggctagtccgttatcaacttgaaaaagtggcaccgagtcggtgc

SEQ ID NO: 29286 - DNA, 97 bp, synthetic construct; identical to SEQ ID NO: 29282
  source 1..97: mol_type = other DNA

SEQ ID NO: 29287 - DNA, 96 bp, synthetic construct; identical to SEQ ID NO: 29249
  source 1..96: mol_type = other DNA

SEQ ID NO: 29288 - DNA, 96 bp, synthetic construct
  source 1..96: mol_type = other DNA
agtaaaatgccactgagaacgttttagagctagaaatagcaagttaaaataaggctagtccgttatcaacttgaaaaagtggcaccgagtcggtgc

SEQ ID NO: 29289 - DNA, 96 bp, synthetic construct
  source 1..96: mol_type = other DNA
aaattacttactgttaatgggttttagagctagaaatagcaagttaaaataaggctagtccgttatcaacttgaaaaagtggcaccgagtcggtgc

SEQ ID NO: 29290 - DNA, 99 bp, synthetic construct; identical to SEQ ID NO: 29273
  source 1..99: mol_type = other DNA

SEQ ID NO: 29291 - DNA, 97 bp, synthetic construct; identical to SEQ ID NO: 29282
  source 1..97: mol_type = other DNA

SEQ ID NO: 29292 - DNA, 97 bp, synthetic construct
  source 1..97: mol_type = other DNA
aaattacttactgttaatggagttttagtactctggaaacagaatctactaaaacaaggcaaaatgccgtgtttatctcgtcaacttgttggcgaga

SEQ ID NO: 29293 - DNA, 97 bp, synthetic construct; identical to SEQ ID NO: 29292
  source 1..97: mol_type = other DNA

SEQ ID NO: 29294 - DNA, 96 bp, synthetic construct
  source 1..96: mol_type = other DNA
atgccactgagaactctcttgttttagagctagaaatagcaagttaaaataaggctagtccgttatcaacttgaaaaagtggcaccgagtcggtgc

SEQ ID NO: 29295 - DNA, 96 bp, synthetic construct
  source 1..96: mol_type = other DNA
gtaaaatgccactgagaactgttttagagctagaaatagcaagttaaaataaggctagtccgttatcaacttgaaaaagtggcaccgagtcggtgc

SEQ ID NO: 29296 - DNA, 96 bp, synthetic construct
  source 1..96: mol_type = other DNA
aattacttactgttaatggagttttagagctagaaatagcaagttaaaataaggctagtccgttatcaacttgaaaaagtggcaccgagtcggtgc

SEQ ID NO: 29297 - DNA, 97 bp, synthetic construct; identical to SEQ ID NO: 29282
  source 1..97: mol_type = other DNA

SEQ ID NO: 29298 - DNA, 97 bp, synthetic construct; identical to SEQ ID NO: 29283
  source 1..97: mol_type = other DNA

SEQ ID NO: 29299 - DNA, 96 bp, synthetic construct
  source 1..96: mol_type = other DNA
tgccactgagaactctcttagttttagagctagaaatagcaagttaaaataaggctagtccgttatcaacttgaaaaagtggcaccgagtcggtgc

SEQ ID NO: 29300 - DNA, 96 bp, synthetic construct
  source 1..96: mol_type = other DNA
taaaatgccactgagaactcgttttagagctagaaatagcaagttaaaataaggctagtccgttatcaacttgaaaaagtggcaccgagtcggtgc

SEQ ID NO: 29301 - DNA, 96 bp, synthetic construct
  source 1..96: mol_type = other DNA
attacttactgttaatggaagttttagagctagaaatagcaagttaaaataaggctagtccgttatcaacttgaaaaagtggcaccgagtcggtgc

SEQ ID NO: 29302 - DNA, 99 bp, synthetic construct; identical to SEQ ID NO: 29273
  source 1..99: mol_type = other DNA

SEQ ID NO: 29303 - DNA, 97 bp, synthetic construct; identical to SEQ ID NO: 29282
  source 1..97: mol_type = other DNA

SEQ ID NO: 29304 - DNA, 96 bp, synthetic construct; identical to SEQ ID NO: 29294
  source 1..96: mol_type = other DNA

SEQ ID NO: 29305 - DNA, 96 bp, synthetic construct
  source 1..96: mol_type = other DNA
aaaatgccactgagaactctgttttagagctagaaatagcaagttaaaataaggctagtccgttatcaacttgaaaaagtggcaccgagtcggtgc

SEQ ID NO: 29306 - DNA, 96 bp, synthetic construct
  source 1..96: mol_type = other DNA
ttacttactgttaatggaatgttttagagctagaaatagcaagttaaaataaggctagtccgttatcaacttgaaaaagtggcaccgagtcggtgc

SEQ ID NO: 29307 - DNA, 170 bp, synthetic construct
  source 1..170: mol_type = other DNA
aaattacttactgttaatggaatgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29308 - DNA, 170 bp, synthetic construct; identical to SEQ ID NO: 29307
  source 1..170: mol_type = other DNA

SEQ ID NO: 29309 - DNA, 97 bp, synthetic construct
  source 1..97: mol_type = other DNA
aaaatgccactgagaactctcgttttagtactctggaaacagaatctactaaaacaaggcaaaatgccgtgtttatctcgtcaacttgttggcgaga

SEQ ID NO: 29310 - DNA, 96 bp, synthetic construct
  source 1..96: mol_type = other DNA
tacttactgttaatggaatcgttttagagctagaaatagcaagttaaaataaggctagtccgttatcaacttgaaaaagtggcaccgagtcggtgc

SEQ ID NO: 29311 - DNA, 96 bp, synthetic construct; identical to SEQ ID NO: 29310
  source 1..96: mol_type = other DNA

SEQ ID NO: 29312 - DNA, 96 bp, synthetic construct
  source 1..96: mol_type = other DNA
aaatgccactgagaactctcgttttagagctagaaatagcaagttaaaataaggctagtccgttatcaacttgaaaaagtggcaccgagtcggtgc

SEQ ID NO: 29313 - DNA, 96 bp, synthetic construct; identical to SEQ ID NO: 29306
  source 1..96: mol_type = other DNA

SEQ ID NO: 29314 - DNA, 96 bp, synthetic construct
  source 1..96: mol_type = other DNA
acttactgttaatggaatcagttttagagctagaaatagcaagttaaaataaggctagtccgttatcaacttgaaaaagtggcaccgagtcggtgc

SEQ ID NO: 29315 - DNA, 96 bp, synthetic construct
  source 1..96: mol_type = other DNA
aatgccactgagaactctctgttttagagctagaaatagcaagttaaaataaggctagtccgttatcaacttgaaaaagtggcaccgagtcggtgc

SEQ ID NO: 29316 - DNA, 170 bp, synthetic construct; identical to SEQ ID NO: 29307
  source 1..170: mol_type = other DNA

SEQ ID NO: 29317 - DNA, 145 bp, synthetic construct; identical to SEQ ID NO: 29221
  source 1..145: mol_type = other DNA

SEQ ID NO: 29318 - DNA, 96 bp, synthetic construct; identical to SEQ ID NO: 29294
  source 1..96: mol_type = other DNA

SEQ ID NO: 29319 - DNA, 96 bp, synthetic construct
  source 1..96: mol_type = other DNA
cttactgttaatggaatcaggttttagagctagaaatagcaagttaaaataaggctagtccgttatcaacttgaaaaagtggcaccgagtcggtgc

SEQ ID NO: 29320 - DNA, 170 bp, synthetic construct
  source 1..170: mol_type = other DNA
cttactgttaatggaatcagccagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29321 - DNA, 96 bp, synthetic construct; identical to SEQ ID NO: 29299
  source 1..96: mol_type = other DNA

SEQ ID NO: 29322 - DNA, 96 bp, synthetic construct; identical to SEQ ID NO: 29310
  source 1..96: mol_type = other DNA

SEQ ID NO: 29323 - DNA, 96 bp, synthetic construct; identical to SEQ ID NO: 29299
  source 1..96: mol_type = other DNA

SEQ ID NO: 29324 - DNA, 96 bp, synthetic construct
  source 1..96: mol_type = other DNA
ttactgttaatggaatcagcgttttagagctagaaatagcaagttaaaataaggctagtccgttatcaacttgaaaaagtggcaccgagtcggtgc

SEQ ID NO: 29325 - DNA, 170 bp, synthetic construct
  source 1..170: mol_type = other DNA
aaaatgccactgagaactctcttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29326 - DNA, 170 bp, synthetic construct; identical to SEQ ID NO: 29325
  source 1..170: mol_type = other DNA

SEQ ID NO: 29327 - DNA, 99 bp, synthetic construct; identical to SEQ ID NO: 29273
  source 1..99: mol_type = other DNA

SEQ ID NO: 29328 - DNA, 97 bp, synthetic construct; identical to SEQ ID NO: 29283
  source 1..97: mol_type = other DNA

SEQ ID NO: 29329 - DNA, 96 bp, synthetic construct; identical to SEQ ID NO: 29294
  source 1..96: mol_type = other DNA

SEQ ID NO: 29330 - DNA, 96 bp, synthetic construct
  source 1..96: mol_type = other DNA
gccactgagaactctcttaagttttagagctagaaatagcaagttaaaataaggctagtccgttatcaacttgaaaaagtggcaccgagtcggtgc

SEQ ID NO: 29331 - DNA, 96 bp, synthetic construct; identical to SEQ ID NO: 29306
  source 1..96: mol_type = other DNA

SEQ ID NO: 29332 - DNA, 96 bp, synthetic construct
  source 1..96: mol_type = other DNA
tactgttaatggaatcagccgttttagagctagaaatagcaagttaaaataaggctagtccgttatcaacttgaaaaagtggcaccgagtcggtgc

SEQ ID NO: 29333 - DNA, 97 bp, synthetic construct; identical to SEQ ID NO: 29283
  source 1..97: mol_type = other DNA

SEQ ID NO: 29334 - DNA, 96 bp, synthetic construct; identical to SEQ ID NO: 29299
  source 1..96: mol_type = other DNA

SEQ ID NO: 29335 - DNA, 96 bp, synthetic construct
  source 1..96: mol_type = other DNA
ccactgagaactctcttaaggttttagagctagaaatagcaagttaaaataaggctagtccgttatcaacttgaaaaagtggcaccgagtcggtgc

SEQ ID NO: 29336 - DNA, 96 bp, synthetic construct
  source 1..96: mol_type = other DNA
actgttaatggaatcagccagttttagagctagaaatagcaagttaaaataaggctagtccgttatcaacttgaaaaagtggcaccgagtcggtgc

SEQ ID NO: 29337 - DNA, 170 bp, synthetic construct; identical to SEQ ID NO: 29320
  source 1..170: mol_type = other DNA

SEQ ID NO: 29338 - DNA, 96 bp, synthetic construct; identical to SEQ ID NO: 29294
  source 1..96: mol_type = other DNA

SEQ ID NO: 29339 - DNA, 96 bp, synthetic construct
  source 1..96: mol_type = other DNA
cactgagaactctcttaagagttttagagctagaaatagcaagttaaaataaggctagtccgttatcaacttgaaaaagtggcaccgagtcggtgc

SEQ ID NO: 29340 - DNA, 96 bp, synthetic construct
  source 1..96: mol_type = other DNA
ctgttaatggaatcagccaagttttagagctagaaatagcaagttaaaataaggctagtccgttatcaacttgaaaaagtggcaccgagtcggtgc

SEQ ID NO: 29341 - DNA, 97 bp, synthetic construct; identical to SEQ ID NO: 29283
  source 1..97: mol_type = other DNA

SEQ ID NO: 29342 - DNA, 96 bp, synthetic construct
  source 1..96: mol_type = other DNA
actgagaactctcttaagacgttttagagctagaaatagcaagttaaaataaggctagtccgttatcaacttgaaaaagtggcaccgagtcggtgc

SEQ ID NO: 29343 - DNA, 96 bp, synthetic construct
  source 1..96: mol_type = other DNA
tgttaatggaatcagccaaagttttagagctagaaatagcaagttaaaataaggctagtccgttatcaacttgaaaaagtggcaccgagtcggtgc

SEQ ID NO: 29344 - DNA, 170 bp, synthetic construct
  source 1..170: mol_type = other DNA
tgccactgagaactctcttaagagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29345 - DNA, 170 bp, synthetic construct; identical to SEQ ID NO: 29344
  source 1..170: mol_type = other DNA

SEQ ID NO: 29346 - DNA, 170 bp, synthetic construct; identical to SEQ ID NO: 29344
  source 1..170: mol_type = other DNA

SEQ ID NO: 29347 - DNA, 97 bp, synthetic construct
  source 1..97: mol_type = other DNA
actctcttaagactacctttcgttttagtactctggaaacagaatctactaaaacaaggcaaaatgccgtgtttatctcgtcaacttgttggcgaga

SEQ ID NO: 29348 - DNA, 96 bp, synthetic construct; identical to SEQ ID NO: 29299
  source 1..96: mol_type = other DNA

SEQ ID NO: 29349 - DNA, 96 bp, synthetic construct
  source 1..96: mol_type = other DNA
ctgagaactctcttaagactgttttagagctagaaatagcaagttaaaataaggctagtccgttatcaacttgaaaaagtggcaccgagtcggtgc

SEQ ID NO: 29350 - DNA, 96 bp, synthetic construct
  source 1..96: mol_type = other DNA
gttaatggaatcagccaaaagttttagagctagaaatagcaagttaaaataaggctagtccgttatcaacttgaaaaagtggcaccgagtcggtgc

SEQ ID NO: 29351 - DNA, 96 bp, synthetic construct; identical to SEQ ID NO: 29294
  source 1..96: mol_type = other DNA

SEQ ID NO: 29352 - DNA, 96 bp, synthetic construct
  source 1..96: mol_type = other DNA
tgagaactctcttaagactagttttagagctagaaatagcaagttaaaataaggctagtccgttatcaacttgaaaaagtggcaccgagtcggtgc

SEQ ID NO: 29353 - DNA, 96 bp, synthetic construct
  source 1..96: mol_type = other DNA
ttaatggaatcagccaaaatgttttagagctagaaatagcaagttaaaataaggctagtccgttatcaacttgaaaaagtggcaccgagtcggtgc

SEQ ID NO: 29354 - DNA, 96 bp, synthetic construct
  source 1..96: mol_type = other DNA
tggaatcagccaaaatcttagttttagagctagaaatagcaagttaaaataaggctagtccgttatcaacttgaaaaagtggcaccgagtcggtgc

SEQ ID NO: 29355 - DNA, 96 bp, synthetic construct
  source 1..96: mol_type = other DNA
taatggaatcagccaaaatcgttttagagctagaaatagcaagttaaaataaggctagtccgttatcaacttgaaaaagtggcaccgagtcggtgc

SEQ ID NO: 29356 - DNA, 96 bp, synthetic construct
  source 1..96: mol_type = other DNA
gagaactctcttaagactacgttttagagctagaaatagcaagttaaaataaggctagtccgttatcaacttgaaaaagtggcaccgagtcggtgc

SEQ ID NO: 29357 - DNA, 170 bp, synthetic construct
  source 1..170: mol_type = other DNA
gttaatggaatcagccaaaatctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29358 - DNA, 170 bp, synthetic construct; identical to SEQ ID NO: 29357
  source 1..170: mol_type = other DNA

SEQ ID NO: 29359 - DNA, 99 bp, synthetic construct
  source 1..99: mol_type = other DNA
gaatcagccaaaatcttaagctggttttagtactctggaaacagaatctactaaaacaaggcaaaatgccgtgtttatctcgtcaacttgttggcgaga

SEQ ID NO: 29360 - DNA, 97 bp, synthetic construct
  source 1..97: mol_type = other DNA
ttaatggaatcagccaaaatcgttttagtactctggaaacagaatctactaaaacaaggcaaaatgccgtgtttatctcgtcaacttgttggcgaga

SEQ ID NO: 29361 - DNA, 96 bp, synthetic construct
  source 1..96: mol_type = other DNA
atggaatcagccaaaatcttgttttagagctagaaatagcaagttaaaataaggctagtccgttatcaacttgaaaaagtggcaccgagtcggtgc

SEQ ID NO: 29362 - DNA, 96 bp, synthetic construct
  source 1..96: mol_type = other DNA
cagccaaaatcttaagctgcgttttagagctagaaatagcaagttaaaataaggctagtccgttatcaacttgaaaaagtggcaccgagtcggtgc

SEQ ID NO: 29363 - DNA, 96 bp, synthetic construct
  source 1..96: mol_type = other DNA
aatggaatcagccaaaatctgttttagagctagaaatagcaagttaaaataaggctagtccgttatcaacttgaaaaagtggcaccgagtcggtgc

SEQ ID NO: 29364 - DNA, 96 bp, synthetic construct; identical to SEQ ID NO: 29299
  source 1..96: mol_type = other DNA

SEQ ID NO: 29365 - DNA, 96 bp, synthetic construct; identical to SEQ ID NO: 29354
  source 1..96: mol_type = other DNA

SEQ ID NO: 29366 - DNA, 96 bp, synthetic construct
  source 1..96: mol_type = other DNA
agaactctcttaagactaccgttttagagctagaaatagcaagttaaaataaggctagtccgttatcaacttgaaaaagtggcaccgagtcggtgc

SEQ ID NO: 29367 - DNA, 99 bp, synthetic construct; identical to SEQ ID NO: 29359
  source 1..99: mol_type = other DNA

SEQ ID NO: 29368 - DNA, 97 bp, synthetic construct; identical to SEQ ID NO: 29360
  source 1..97: mol_type = other DNA

SEQ ID NO: 29369 - DNA, 97 bp, synthetic construct
  source 1..97: mol_type = other DNA
atcagccaaaatcttaagctggttttagtactctggaaacagaatctactaaaacaaggcaaaatgccgtgtttatctcgtcaacttgttggcgaga

SEQ ID NO: 29370 - DNA, 97 bp, synthetic construct
  source 1..97: mol_type = other DNA
taatggaatcagccaaaatctgttttagtactctggaaacagaatctactaaaacaaggcaaaatgccgtgtttatctcgtcaacttgttggcgaga

SEQ ID NO: 29371 - DNA, 96 bp, synthetic construct
  source 1..96: mol_type = other DNA
ttaagactacctttctccaagttttagagctagaaatagcaagttaaaataaggctagtccgttatcaacttgaaaaagtggcaccgagtcggtgc

SEQ ID NO: 29372 - DNA, 96 bp, synthetic construct; identical to SEQ ID NO: 29253
  source 1..96: mol_type = other DNA

SEQ ID NO: 29373 - DNA, 96 bp, synthetic construct
  source 1..96: mol_type = other DNA
gaactctcttaagactacctgttttagagctagaaatagcaagttaaaataaggctagtccgttatcaacttgaaaaagtggcaccgagtcggtgc

SEQ ID NO: 29374 - DNA, 96 bp, synthetic construct; identical to SEQ ID NO: 29361
  source 1..96: mol_type = other DNA

SEQ ID NO: 29375 - DNA, 96 bp, synthetic construct; identical to SEQ ID NO: 29361
  source 1..96: mol_type = other DNA

SEQ ID NO: 29376 - DNA, 96 bp, synthetic construct; identical to SEQ ID NO: 29299
  source 1..96: mol_type = other DNA

SEQ ID NO: 29377 - DNA, 170 bp, synthetic construct
  source 1..170: mol_type = other DNA
tgagaactctcttaagactacctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29378 - DNA, 170 bp, synthetic construct; identical to SEQ ID NO: 29377
  source 1..170: mol_type = other DNA

SEQ ID NO: 29379 - DNA, 97 bp, synthetic construct; identical to SEQ ID NO: 29360
  source 1..97: mol_type = other DNA

SEQ ID NO: 29380 - DNA, 97 bp, synthetic construct; identical to SEQ ID NO: 29222
  source 1..97: mol_type = other DNA

SEQ ID NO: 29381 - DNA, 97 bp, synthetic construct; identical to SEQ ID NO: 29222
  source 1..97: mol_type = other DNA

SEQ ID NO: 29382 - DNA, 97 bp, synthetic construct; identical to SEQ ID NO: 29370
  source 1..97: mol_type = other DNA

SEQ ID NO: 29383 - DNA, 96 bp, synthetic construct; identical to SEQ ID NO: 29371
  source 1..96: mol_type = other DNA

SEQ ID NO: 29384 - DNA, 96 bp, synthetic construct; identical to SEQ ID NO: 29253
  source 1..96: mol_type = other DNA

SEQ ID NO: 29385 - DNA, 96 bp, synthetic construct
  source 1..96: mol_type = other DNA
aactctcttaagactaccttgttttagagctagaaatagcaagttaaaataaggctagtccgttatcaacttgaaaaagtggcaccgagtcggtgc

SEQ ID NO: 29386 - DNA, 96 bp, synthetic construct; identical to SEQ ID NO: 29253
  source 1..96: mol_type = other DNA

SEQ ID NO: 29387 - DNA, 96 bp, synthetic construct; identical to SEQ ID NO: 29354
  source 1..96: mol_type = other DNA

SEQ ID NO: 29388 - DNA, 104 bp, synthetic construct
  source 1..104: mol_type = other DNA
gtgtaaattacttactgttagtctttgtactctggtaccagaagctacaaagataaggcttcatgccgaaatcaacaccctgtcattttatggcagggtgtttt

SEQ ID NO: 29389 - DNA, 99 bp, synthetic construct; identical to SEQ ID NO: 29273
  source 1..99: mol_type = other DNA

SEQ ID NO: 29390 - DNA, 97 bp, synthetic construct; identical to SEQ ID NO: 29347
  source 1..97: mol_type = other DNA

SEQ ID NO: 29391 - DNA, 99 bp, synthetic construct; identical to SEQ ID NO: 29273
  source 1..99: mol_type = other DNA

SEQ ID NO: 29392 - DNA, 97 bp, synthetic construct; identical to SEQ ID NO: 29347
  source 1..97: mol_type = other DNA

SEQ ID NO: 29393 - DNA, 97 bp, synthetic construct
  source 1..97: mol_type = other DNA
aatcagccaaaatcttaagctgttttagtactctggaaacagaatctactaaaacaaggcaaaatgccgtgtttatctcgtcaacttgttggcgaga

SEQ ID NO: 29394 - DNA, 97 bp, synthetic construct; identical to SEQ ID NO: 29222
  source 1..97: mol_type = other DNA

SEQ ID NO: 29395 - DNA, 97 bp, synthetic construct; identical to SEQ ID NO: 29222
  source 1..97: mol_type = other DNA

SEQ ID NO: 29396 - DNA, 96 bp, synthetic construct; identical to SEQ ID NO: 29371
  source 1..96: mol_type = other DNA

SEQ ID NO: 29397 - DNA, 96 bp, synthetic construct
  source 1..96: mol_type = other DNA
actctcttaagactacctttgttttagagctagaaatagcaagttaaaataaggctagtccgttatcaacttgaaaaagtggcaccgagtcggtgc

SEQ ID NO: 29398 - DNA, 96 bp, synthetic construct
  source 1..96: mol_type = other DNA
ggaatcagccaaaatcttaagttttagagctagaaatagcaagttaaaataaggctagtccgttatcaacttgaaaaagtggcaccgagtcggtgc

SEQ ID NO: 29399 - DNA, 187 bp, synthetic construct
  source 1..187: mol_type = other DNA
tcttgggtggcctggccttccaaggttgtagctccctttctcatttcggaaacgaaatgagaaccgttgctacaataaggccgtctgaaaagatgtgccgcaacgctctgccccttaaagcttctgctttaaggggcatcgtttagtctgatgtactgtgtgcagtggaagactcggaaggccaggc

SEQ ID NO: 29400 - DNA, 138 bp, synthetic construct
  source 1..138: mol_type = other DNA
gggtggcctggccttccaaggttttagagctagaaatagcaagttaaaataaggctagtccgttatcaacttgaaaaagtggcaccgagtcggtgcgtctgatgtactgtgtgcagtggaagactcggaaggccaggc

SEQ ID NO: 29401 - DNA, 212 bp, synthetic construct
  source 1..212: mol_type = other DNA
cttgggtggcctggccttccaaggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgtctgatgtactgtgtgcagtggaagactcggaaggccaggc

SEQ ID NO: 29402 - DNA, 139 bp, synthetic construct
  source 1..139: mol_type = other DNA
ctgtgtgcagtggaagacttggttttagtactctggaaacagaatctactaaaacaaggcaaaatgccgtgtttatctcgtcaacttgttggcgagacgggatttcttgggtggcctggccttccgagtcttccactgc

SEQ ID NO: 29403 - DNA, 139 bp, synthetic construct; identical to SEQ ID NO: 29402
  source 1..139: mol_type = other DNA

SEQ ID NO: 29404 - DNA, 138 bp, synthetic construct
  source 1..138: mol_type = other DNA
tgtgtgcagtggaagacttggttttagagctagaaatagcaagttaaaataaggctagtccgttatcaacttgaaaaagtggcaccgagtcggtgccgggatttcttgggtggcctggccttccgagtcttccactgc

SEQ ID NO: 29405 - DNA, 138 bp, synthetic construct
  source 1..138: mol_type = other DNA
tgggtggcctggccttccaagttttagagctagaaatagcaagttaaaataaggctagtccgttatcaacttgaaaaagtggcaccgagtcggtgctctgatgtactgtgtgcagtggaagactcggaaggccaggcc

SEQ ID NO: 29406 - DNA, 139 bp, synthetic construct
  source 1..139: mol_type = other DNA
actgtgtgcagtggaagacttgttttagtactctggaaacagaatctactaaaacaaggcaaaatgccgtgtttatctcgtcaacttgttggcgagagggatttcttgggtggcctggccttccgagtcttccactgca

SEQ ID NO: 29407 - DNA, 138 bp, synthetic construct
  source 1..138: mol_type = other DNA
ttgggtggcctggccttccagttttagagctagaaatagcaagttaaaataaggctagtccgttatcaacttgaaaaagtggcaccgagtcggtgcctgatgtactgtgtgcagtggaagactcggaaggccaggcca

SEQ ID NO: 29408 - DNA, 138 bp, synthetic construct
  source 1..138: mol_type = other DNA
ctgtgtgcagtggaagacttgttttagagctagaaatagcaagttaaaataaggctagtccgttatcaacttgaaaaagtggcaccgagtcggtgcgggatttcttgggtggcctggccttccgagtcttccactgca

SEQ ID NO: 29409 - DNA, 138 bp, synthetic construct; identical to SEQ ID NO: 29407
  source 1..138: mol_type = other DNA

SEQ ID NO: 29410 - DNA, 138 bp, synthetic construct; identical to SEQ ID NO: 29408
  source 1..138: mol_type = other DNA

SEQ ID NO: 29411 - DNA, 141 bp, synthetic construct
  source 1..141: mol_type = other DNA
tgtactgtgtgcagtggaagactgttttagtactctggaaacagaatctactaaaacaaggcaaaatgccgtgtttatctcgtcaacttgttggcgagaggatttcttgggtggcctggccttccgagtcttccactgcac

SEQ ID NO: 29412 - DNA, 139 bp, synthetic construct
  source 1..139: mol_type = other DNA
tactgtgtgcagtggaagactgttttagtactctggaaacagaatctactaaaacaaggcaaaatgccgtgtttatctcgtcaacttgttggcgagaggatttcttgggtggcctggccttccgagtcttccactgcac

SEQ ID NO: 29413 - DNA, 138 bp, synthetic construct
  source 1..138: mol_type = other DNA
cttgggtggcctggccttccgttttagagctagaaatagcaagttaaaataaggctagtccgttatcaacttgaaaaagtggcaccgagtcggtgctgatgtactgtgtgcagtggaagactcggaaggccaggccac

SEQ ID NO: 29414 - DNA, 138 bp, synthetic construct; identical to SEQ ID NO: 29413
  source 1..138: mol_type = other DNA

SEQ ID NO: 29415 - DNA, 138 bp, synthetic construct
  source 1..138: mol_type = other DNA
actgtgtgcagtggaagactgttttagagctagaaatagcaagttaaaataaggctagtccgttatcaacttgaaaaagtggcaccgagtcggtgcggatttcttgggtggcctggccttccgagtcttccactgcac

SEQ ID NO: 29416 - DNA, 138 bp, synthetic construct; identical to SEQ ID NO: 29415
  source 1..138: mol_type = other DNA

SEQ ID NO: 29417 - DNA, 138 bp, synthetic construct; identical to SEQ ID NO: 29415
  source 1..138: mol_type = other DNA

SEQ ID NO: 29418 - DNA, 138 bp, synthetic construct; identical to SEQ ID NO: 29415
  source 1..138: mol_type = other DNA

SEQ ID NO: 29419 - DNA, 212 bp, synthetic construct
  source 1..212: mol_type = other DNA
tttcttgggtggcctggccttccgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttgatgtactgtgtgcagtggaagactcggaaggccaggccac

SEQ ID NO: 29420 - DNA, 141 bp, synthetic construct
  source 1..141: mol_type = other DNA
atgtactgtgtgcagtggaagacgttttagtactctggaaacagaatctactaaaacaaggcaaaatgccgtgtttatctcgtcaacttgttggcgagagatttcttgggtggcctggccttccgagtcttccactgcaca

SEQ ID NO: 29421 - DNA, 139 bp, synthetic construct
  source 1..139: mol_type = other DNA
gtactgtgtgcagtggaagacgttttagtactctggaaacagaatctactaaaacaaggcaaaatgccgtgtttatctcgtcaacttgttggcgagagatttcttgggtggcctggccttccgagtcttccactgcaca

SEQ ID NO: 29422 - DNA, 139 bp, synthetic construct; identical to SEQ ID NO: 29421
  source 1..139: mol_type = other DNA

SEQ ID NO: 29423 - DNA, 139 bp, synthetic construct; identical to SEQ ID NO: 29421
  source 1..139: mol_type = other DNA

SEQ ID NO: 29424 - DNA, 139 bp, synthetic construct
  source 1..139: mol_type = other DNA
ttcttgggtggcctggccttcgttttagtactctggaaacagaatctactaaaacaaggcaaaatgccgtgtttatctcgtcaacttgttggcgagagatgtactgtgtgcagtggaagactcggaaggccaggccacc

SEQ ID NO: 29425 - DNA, 138 bp, synthetic construct
  source 1..138: mol_type = other DNA
tactgtgtgcagtggaagacgttttagagctagaaatagcaagttaaaataaggctagtccgttatcaacttgaaaaagtggcaccgagtcggtgcgatttcttgggtggcctggccttccgagtcttccactgcaca

SEQ ID NO: 29426 - DNA, 138 bp, synthetic construct; identical to SEQ ID NO: 29425
  source 1..138: mol_type = other DNA

SEQ ID NO: 29427 - DNA, 138 bp, synthetic construct
  source 1..138: mol_type = other DNA
tcttgggtggcctggccttcgttttagagctagaaatagcaagttaaaataaggctagtccgttatcaacttgaaaaagtggcaccgagtcggtgcgatgtactgtgtgcagtggaagactcggaaggccaggccacc

SEQ ID NO: 29428 - DNA, 139 bp, synthetic construct
  source 1..139: mol_type = other DNA
tttcttgggtggcctggccttgttttagtactctggaaacagaatctactaaaacaaggcaaaatgccgtgtttatctcgtcaacttgttggcgagaatgtactgtgtgcagtggaagactcggaaggccaggccaccc

SEQ ID NO: 29429 - DNA, 139 bp, synthetic construct
  source 1..139: mol_type = other DNA
tgtactgtgtgcagtggaagagttttagtactctggaaacagaatctactaaaacaaggcaaaatgccgtgtttatctcgtcaacttgttggcgagaatttcttgggtggcctggccttccgagtcttccactgcacac

SEQ ID NO: 29430 - DNA, 139 bp, synthetic construct; identical to SEQ ID NO: 29428
  source 1..139: mol_type = other DNA

SEQ ID NO: 29431 - DNA, 138 bp, synthetic construct
  source 1..138: mol_type = other DNA
gtactgtgtgcagtggaagagttttagagctagaaatagcaagttaaaataaggctagtccgttatcaacttgaaaaagtggcaccgagtcggtgcatttcttgggtggcctggccttccgagtcttccactgcacac

SEQ ID NO: 29432 - DNA, 138 bp, synthetic construct
  source 1..138: mol_type = other DNA
ttcttgggtggcctggccttgttttagagctagaaatagcaagttaaaataaggctagtccgttatcaacttgaaaaagtggcaccgagtcggtgcatgtactgtgtgcagtggaagactcggaaggccaggccaccc

SEQ ID NO: 29433 - DNA, 139 bp, synthetic construct
  source 1..139: mol_type = other DNA
atttcttgggtggcctggcctgttttagtactctggaaacagaatctactaaaacaaggcaaaatgccgtgtttatctcgtcaacttgttggcgagatgtactgtgtgcagtggaagactcggaaggccaggccaccca

SEQ ID NO: 29434 - DNA, 138 bp, synthetic construct
  source 1..138: mol_type = other DNA
tgtactgtgtgcagtggaaggttttagagctagaaatagcaagttaaaataaggctagtccgttatcaacttgaaaaagtggcaccgagtcggtgctttcttgggtggcctggccttccgagtcttccactgcacaca

SEQ ID NO: 29435 - DNA, 138 bp, synthetic construct
  source 1..138: mol_type = other DNA
tttcttgggtggcctggcctgttttagagctagaaatagcaagttaaaataaggctagtccgttatcaacttgaaaaagtggcaccgagtcggtgctgtactgtgtgcagtggaagactcggaaggccaggccaccca

SEQ ID NO: 29436 - DNA, 138 bp, synthetic construct
  source 1..138: mol_type = other DNA
atgtactgtgtgcagtggaagttttagagctagaaatagcaagttaaaataaggctagtccgttatcaacttgaaaaagtggcaccgagtcggtgcttcttgggtggcctggccttccgagtcttccactgcacacag

SEQ ID NO: 29437 - DNA, 138 bp, synthetic construct
  source 1..138: mol_type = other DNA
atttcttgggtggcctggccgttttagagctagaaatagcaagttaaaataaggctagtccgttatcaacttgaaaaagtggcaccgagtcggtgcgtactgtgtgcagtggaagactcggaaggccaggccacccaa

SEQ ID NO: 29438 - DNA, 138 bp, synthetic construct
  source 1..138: mol_type = other DNA
gatgtactgtgtgcagtggagttttagagctagaaatagcaagttaaaataaggctagtccgttatcaacttgaaaaagtggcaccgagtcggtgctcttgggtggcctggccttccgagtcttccactgcacacagt

SEQ ID NO: 29439 - DNA, 138 bp, synthetic construct; identical to SEQ ID NO: 29438
  source 1..138: mol_type = other DNA

SEQ ID NO: 29440 - DNA, 138 bp, synthetic construct
  source 1..138: mol_type = other DNA
gatttcttgggtggcctggcgttttagagctagaaatagcaagttaaaataaggctagtccgttatcaacttgaaaaagtggcaccgagtcggtgctactgtgtgcagtggaagactcggaaggccaggccacccaag

SEQ ID NO: 29441 - DNA, 212 bp, synthetic construct
  source 1..212: mol_type = other DNA
cgggatttcttgggtggcctggcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttactgtgtgcagtggaagactcggaaggccaggccacccaag

SEQ ID NO: 29442 - DNA, 212 bp, synthetic construct; identical to SEQ ID NO: 29441
  source 1..212: mol_type = other DNA

SEQ ID NO: 29443 - DNA, 187 bp, synthetic construct
  source 1..187: mol_type = other DNA
ctcgggatttcttgggtggcctgggttgtagctccctttctcatttcggaaacgaaatgagaaccgttgctacaataaggccgtctgaaaagatgtgccgcaacgctctgccccttaaagcttctgctttaaggggcatcgtttaactgtgtgcagtggaagactcggaaggccaggccacccaaga

SEQ ID NO: 29444 - DNA, 138 bp, synthetic construct
  source 1..138: mol_type = other DNA
tgatgtactgtgtgcagtgggttttagagctagaaatagcaagttaaaataaggctagtccgttatcaacttgaaaaagtggcaccgagtcggtgccttgggtggcctggccttccgagtcttccactgcacacagta

SEQ ID NO: 29445 - DNA, 138 bp, synthetic construct; identical to SEQ ID NO: 29444
  source 1..138: mol_type = other DNA

SEQ ID NO: 29446 - DNA, 138 bp, synthetic construct
  source 1..138: mol_type = other DNA
ggatttcttgggtggcctgggttttagagctagaaatagcaagttaaaataaggctagtccgttatcaacttgaaaaagtggcaccgagtcggtgcactgtgtgcagtggaagactcggaaggccaggccacccaaga

SEQ ID NO: 29447 - DNA, 212 bp, synthetic construct
  source 1..212: mol_type = other DNA
gtctgatgtactgtgtgcagtgggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcttgggtggcctggccttccgagtcttccactgcacacagta

SEQ ID NO: 29448 - DNA, 212 bp, synthetic construct
  source 1..212: mol_type = other DNA
tcgggatttcttgggtggcctgggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctactgtgtgcagtggaagactcggaaggccaggccacccaaga

SEQ ID NO: 29449 - DNA, 212 bp, synthetic construct; identical to SEQ ID NO: 29448
  source 1..212: mol_type = other DNA

SEQ ID NO: 29450 - DNA, 212 bp, synthetic construct; identical to SEQ ID NO: 29447
  source 1..212: mol_type = other DNA

SEQ ID NO: 29451 - DNA, 212 bp, synthetic construct; identical to SEQ ID NO: 29448
  source 1..212: mol_type = other DNA

SEQ ID NO: 29452 - DNA, 139 bp, synthetic construct
  source 1..139: mol_type = other DNA
tctgatgtactgtgtgcagtggttttagtactctggaaacagaatctactaaaacaaggcaaaatgccgtgtttatctcgtcaacttgttggcgagattgggtggcctggccttccgagtcttccactgcacacagtac

SEQ ID NO: 29453 - DNA, 139 bp, synthetic construct; identical to SEQ ID NO: 29452
  source 1..139: mol_type = other DNA

SEQ ID NO: 29454 - DNA, 138 bp, synthetic construct
  source 1..138: mol_type = other DNA
ctgatgtactgtgtgcagtggttttagagctagaaatagcaagttaaaataaggctagtccgttatcaacttgaaaaagtggcaccgagtcggtgcttgggtggcctggccttccgagtcttccactgcacacagtac

SEQ ID NO: 29455 - DNA, 138 bp, synthetic construct
  source 1..138: mol_type = other DNA
gggatttcttgggtggcctggttttagagctagaaatagcaagttaaaataaggctagtccgttatcaacttgaaaaagtggcaccgagtcggtgcctgtgtgcagtggaagactcggaaggccaggccacccaagaa

SEQ ID NO: 29456 - DNA, 139 bp, synthetic construct
  source 1..139: mol_type = other DNA
gtctgatgtactgtgtgcagtgttttagtactctggaaacagaatctactaaaacaaggcaaaatgccgtgtttatctcgtcaacttgttggcgagatgggtggcctggccttccgagtcttccactgcacacagtaca

SEQ ID NO: 29457 - DNA, 138 bp, synthetic construct
  source 1..138: mol_type = other DNA
tctgatgtactgtgtgcagtgttttagagctagaaatagcaagttaaaataaggctagtccgttatcaacttgaaaaagtggcaccgagtcggtgctgggtggcctggccttccgagtcttccactgcacacagtaca

SEQ ID NO: 29458 - DNA, 138 bp, synthetic construct
  source 1..138: mol_type = other DNA
cgggatttcttgggtggcctgttttagagctagaaatagcaagttaaaataaggctagtccgttatcaacttgaaaaagtggcaccgagtcggtgctgtgtgcagtggaagactcggaaggccaggccacccaagaaa

SEQ ID NO: 29459 - DNA, 138 bp, synthetic construct; identical to SEQ ID NO: 29457
  source 1..138: mol_type = other DNA

SEQ ID NO: 29460 - DNA, 138 bp, synthetic construct; identical to SEQ ID NO: 29458
  source 1..138: mol_type = other DNA

SEQ ID NO: 29461 - DNA, 141 bp, synthetic construct
  source 1..141: mol_type = other DNA
catgtctgatgtactgtgtgcaggttttagtactctggaaacagaatctactaaaacaaggcaaaatgccgtgtttatctcgtcaacttgttggcgagagggtggcctggccttccgagtcttccactgcacacagtacat

SEQ ID NO: 29462 - DNA, 139 bp, synthetic construct
  source 1..139: mol_type = other DNA
tgtctgatgtactgtgtgcaggttttagtactctggaaacagaatctactaaaacaaggcaaaatgccgtgtttatctcgtcaacttgttggcgagagggtggcctggccttccgagtcttccactgcacacagtacat

SEQ ID NO: 29463 - DNA, 138 bp, synthetic construct
  source 1..138: mol_type = other DNA
gtctgatgtactgtgtgcaggttttagagctagaaatagcaagttaaaataaggctagtccgttatcaacttgaaaaagtggcaccgagtcggtgcgggtggcctggccttccgagtcttccactgcacacagtacat

SEQ ID NO: 29464 - DNA, 138 bp, synthetic construct; identical to SEQ ID NO: 29463
  source 1..138: mol_type = other DNA

SEQ ID NO: 29465 - DNA, 138 bp, synthetic construct; identical to SEQ ID NO: 29463
  source 1..138: mol_type = other DNA

SEQ ID NO: 29466 - DNA, 138 bp, synthetic construct
  source 1..138: mol_type = other DNA
tcgggatttcttgggtggccgttttagagctagaaatagcaagttaaaataaggctagtccgttatcaacttgaaaaagtggcaccgagtcggtgcgtgtgcagtggaagactcggaaggccaggccacccaagaaat

SEQ ID NO: 29467 - DNA, 138 bp, synthetic construct; identical to SEQ ID NO: 29466
  source 1..138: mol_type = other DNA

SEQ ID NO: 29468 - DNA, 138 bp, synthetic construct; identical to SEQ ID NO: 29466
  source 1..138: mol_type = other DNA

SEQ ID NO: 29469 - DNA, 138 bp, synthetic construct; identical to SEQ ID NO: 29463
  source 1..138: mol_type = other DNA

SEQ ID NO: 29470 - DNA, 138 bp, synthetic construct; identical to SEQ ID NO: 29466
  source 1..138: mol_type = other DNA

SEQ ID NO: 29471 - DNA, 212 bp, synthetic construct
  source 1..212: mol_type = other DNA
ctctcgggatttcttgggtggccgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgtgtgcagtggaagactcggaaggccaggccacccaagaaat

SEQ ID NO: 29472 - DNA, 187 bp, synthetic construct
  source 1..187: mol_type = other DNA
tcctctcgggatttcttgggtggcgttgtagctccctttctcatttcggaaacgaaatgagaaccgttgctacaataaggccgtctgaaaagatgtgccgcaacgctctgccccttaaagcttctgctttaaggggcatcgtttatgtgcagtggaagactcggaaggccaggccacccaagaaatc

SEQ ID NO: 29473 - DNA, 141 bp, synthetic construct
  source 1..141: mol_type = other DNA
ccatgtctgatgtactgtgtgcagttttagtactctggaaacagaatctactaaaacaaggcaaaatgccgtgtttatctcgtcaacttgttggcgagaggtggcctggccttccgagtcttccactgcacacagtacatc

SEQ ID NO: 29474 - DNA, 139 bp, synthetic construct
  source 1..139: mol_type = other DNA
atgtctgatgtactgtgtgcagttttagtactctggaaacagaatctactaaaacaaggcaaaatgccgtgtttatctcgtcaacttgttggcgagaggtggcctggccttccgagtcttccactgcacacagtacatc

SEQ ID NO: 29475 - DNA, 139 bp, synthetic construct; identical to SEQ ID NO: 29474
  source 1..139: mol_type = other DNA

SEQ ID NO: 29476 - DNA, 139 bp, synthetic construct; identical to SEQ ID NO: 29474
  source 1..139: mol_type = other DNA

SEQ ID NO: 29477 - DNA, 139 bp, synthetic construct
  source 1..139: mol_type = other DNA
tctcgggatttcttgggtggcgttttagtactctggaaacagaatctactaaaacaaggcaaaatgccgtgtttatctcgtcaacttgttggcgagatgtgcagtggaagactcggaaggccaggccacccaagaaatc

SEQ ID NO: 29478 - DNA, 139 bp, synthetic construct; identical to SEQ ID NO: 29477
  source 1..139: mol_type = other DNA

SEQ ID NO: 29479 - DNA, 138 bp, synthetic construct
  source 1..138: mol_type = other DNA
tgtctgatgtactgtgtgcagttttagagctagaaatagcaagttaaaataaggctagtccgttatcaacttgaaaaagtggcaccgagtcggtgcggtggcctggccttccgagtcttccactgcacacagtacatc

SEQ ID NO: 29480 - DNA, 138 bp, synthetic construct; identical to SEQ ID NO: 29479
  source 1..138: mol_type = other DNA

SEQ ID NO: 29481 - DNA, 138 bp, synthetic construct
  source 1..138: mol_type = other DNA
ctcgggatttcttgggtggcgttttagagctagaaatagcaagttaaaataaggctagtccgttatcaacttgaaaaagtggcaccgagtcggtgctgtgcagtggaagactcggaaggccaggccacccaagaaatc

SEQ ID NO: 29482 - DNA, 138 bp, synthetic construct; identical to SEQ ID NO: 29481
  source 1..138: mol_type = other DNA

SEQ ID NO: 29483 - DNA, 212 bp, synthetic construct
  source 1..212: mol_type = other DNA
cctctcgggatttcttgggtggcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttgtgcagtggaagactcggaaggccaggccacccaagaaatc

SEQ ID NO: 29484 - DNA, 212 bp, synthetic construct; identical to SEQ ID NO: 29483
  source 1..212: mol_type = other DNA

SEQ ID NO: 29485 - DNA, 139 bp, synthetic construct
  source 1..139: mol_type = other DNA
catgtctgatgtactgtgtgcgttttagtactctggaaacagaatctactaaaacaaggcaaaatgccgtgtttatctcgtcaacttgttggcgagagtggcctggccttccgagtcttccactgcacacagtacatca

SEQ ID NO: 29486 - DNA, 139 bp, synthetic construct
  source 1..139: mol_type = other DNA
ctctcgggatttcttgggtgggttttagtactctggaaacagaatctactaaaacaaggcaaaatgccgtgtttatctcgtcaacttgttggcgagagtgcagtggaagactcggaaggccaggccacccaagaaatcc

SEQ ID NO: 29487 - DNA, 138 bp, synthetic construct
  source 1..138: mol_type = other DNA
atgtctgatgtactgtgtgcgttttagagctagaaatagcaagttaaaataaggctagtccgttatcaacttgaaaaagtggcaccgagtcggtgcgtggcctggccttccgagtcttccactgcacacagtacatca

SEQ ID NO: 29488 - DNA, 138 bp, synthetic construct; identical to SEQ ID NO: 29487
  source 1..138: mol_type = other DNA

SEQ ID NO: 29489 - DNA, 138 bp, synthetic construct
  source 1..138: mol_type = other DNA
tctcgggatttcttgggtgggttttagagctagaaatagcaagttaaaataaggctagtccgttatcaacttgaaaaagtggcaccgagtcggtgcgtgcagtggaagactcggaaggccaggccacccaagaaatcc

SEQ ID NO: 29490 - DNA, 138 bp, synthetic construct
  source 1..138: mol_type = other DNA
catgtctgatgtactgtgtggttttagagctagaaatagcaagttaaaataaggctagtccgttatcaacttgaaaaagtggcaccgagtcggtgctggcctggccttccgagtcttccactgcacacagtacatcag

SEQ ID NO: 29491 - DNA, 138 bp, synthetic construct; identical to SEQ ID NO: 29490
  source 1..138: mol_type = other DNA

SEQ ID NO: 29492 - DNA, 138 bp, synthetic construct
  source 1..138: mol_type = other DNA
ctctcgggatttcttgggtggttttagagctagaaatagcaagttaaaataaggctagtccgttatcaacttgaaaaagtggcaccgagtcggtgctgcagtggaagactcggaaggccaggccacccaagaaatccc

SEQ ID NO: 29493 - DNA, 139 bp, synthetic construct
  source 1..139: mol_type = other DNA
tccatgtctgatgtactgtgtgttttagtactctggaaacagaatctactaaaacaaggcaaaatgccgtgtttatctcgtcaacttgttggcgagaggcctggccttccgagtcttccactgcacacagtacatcaga

SEQ ID NO: 29494 - DNA, 138 bp, synthetic construct
  source 1..138: mol_type = other DNA
cctctcgggatttcttgggtgttttagagctagaaatagcaagttaaaataaggctagtccgttatcaacttgaaaaagtggcaccgagtcggtgcgcagtggaagactcggaaggccaggccacccaagaaatcccg

SEQ ID NO: 29495 - DNA, 138 bp, synthetic construct; identical to SEQ ID NO: 29494
  source 1..138: mol_type = other DNA

SEQ ID NO: 29496 - DNA, 138 bp, synthetic construct
  source 1..138: mol_type = other DNA
ccatgtctgatgtactgtgtgttttagagctagaaatagcaagttaaaataaggctagtccgttatcaacttgaaaaagtggcaccgagtcggtgcggcctggccttccgagtcttccactgcacacagtacatcaga

SEQ ID NO: 29497 - DNA, 139 bp, synthetic construct
  source 1..139: mol_type = other DNA
atccatgtctgatgtactgtggttttagtactctggaaacagaatctactaaaacaaggcaaaatgccgtgtttatctcgtcaacttgttggcgagagcctggccttccgagtcttccactgcacacagtacatcagac

SEQ ID NO: 29498 - DNA, 139 bp, synthetic construct; identical to SEQ ID NO: 29497
  source 1..139: mol_type = other DNA

SEQ ID NO: 29499 - DNA, 138 bp, synthetic construct
  source 1..138: mol_type = other DNA
tcctctcgggatttcttggggttttagagctagaaatagcaagttaaaataaggctagtccgttatcaacttgaaaaagtggcaccgagtcggtgccagtggaagactcggaaggccaggccacccaagaaatcccga

SEQ ID NO: 29500 - DNA, 138 bp, synthetic construct; identical to SEQ ID NO: 29499
  source 1..138: mol_type = other DNA

SEQ ID NO: 29501 - DNA, 138 bp, synthetic construct; identical to SEQ ID NO: 29499
  source 1..138: mol_type = other DNA

SEQ ID NO: 29502 - DNA, 138 bp, synthetic construct
  source 1..138: mol_type = other DNA
tccatgtctgatgtactgtggttttagagctagaaatagcaagttaaaataaggctagtccgttatcaacttgaaaaagtggcaccgagtcggtgcgcctggccttccgagtcttccactgcacacagtacatcagac

SEQ ID NO: 29503 - DNA, 138 bp, synthetic construct; identical to SEQ ID NO: 29499
  source 1..138: mol_type = other DNA

SEQ ID NO: 29504 - DNA, 138 bp, synthetic construct; identical to SEQ ID NO: 29502
  source 1..138: mol_type = other DNA

SEQ ID NO: 29505 - DNA, 212 bp, synthetic construct
  source 1..212: mol_type = other DNA
ctttcctctcgggatttcttggggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcagtggaagactcggaaggccaggccacccaagaaatcccga

SEQ ID NO: 29506 - DNA, 212 bp, synthetic construct; identical to SEQ ID NO: 29505
  source 1..212: mol_type = other DNA

SEQ ID NO: 29507 - DNA, 187 bp, synthetic construct
  source 1..187: mol_type = other DNA
tgctttcctctcgggatttcttgggttgtagctccctttctcatttcggaaacgaaatgagaaccgttgctacaataaggccgtctgaaaagatgtgccgcaacgctctgccccttaaagcttctgctttaaggggcatcgtttaagtggaagactcggaaggccaggccacccaagaaatcccgag

SEQ ID NO: 29508 - DNA, 139 bp, synthetic construct
  source 1..139: mol_type = other DNA
tttcctctcgggatttcttgggttttagtactctggaaacagaatctactaaaacaaggcaaaatgccgtgtttatctcgtcaacttgttggcgagaagtggaagactcggaaggccaggccacccaagaaatcccgag

SEQ ID NO: 29509 - DNA, 139 bp, synthetic construct; identical to SEQ ID NO: 29508
  source 1..139: mol_type = other DNA

SEQ ID NO: 29510 - DNA, 138 bp, synthetic construct
  source 1..138: mol_type = other DNA
atccatgtctgatgtactgtgttttagagctagaaatagcaagttaaaataaggctagtccgttatcaacttgaaaaagtggcaccgagtcggtgccctggccttccgagtcttccactgcacacagtacatcagaca

SEQ ID NO: 29511 - DNA, 138 bp, synthetic construct; identical to SEQ ID NO: 29510
  source 1..138: mol_type = other DNA

SEQ ID NO: 29512 - DNA, 138 bp, synthetic construct
  source 1..138: mol_type = other DNA
ttcctctcgggatttcttgggttttagagctagaaatagcaagttaaaataaggctagtccgttatcaacttgaaaaagtggcaccgagtcggtgcagtggaagactcggaaggccaggccacccaagaaatcccgag

SEQ ID NO: 29513 - DNA, 138 bp, synthetic construct; identical to SEQ ID NO: 29512
  source 1..138: mol_type = other DNA

SEQ ID NO: 29514 - DNA, 212 bp, synthetic construct
  source 1..212: mol_type = other DNA
gctttcctctcgggatttcttgggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctagtggaagactcggaaggccaggccacccaagaaatcccgag

SEQ ID NO: 29515 - DNA, 212 bp, synthetic construct; identical to SEQ ID NO: 29514
  source 1..212: mol_type = other DNA

SEQ ID NO: 29516 - DNA, 139 bp, synthetic construct
  source 1..139: mol_type = other DNA
ctttcctctcgggatttcttggttttagtactctggaaacagaatctactaaaacaaggcaaaatgccgtgtttatctcgtcaacttgttggcgagagtggaagactcggaaggccaggccacccaagaaatcccgaga

SEQ ID NO: 29517 - DNA, 138 bp, synthetic construct
  source 1..138: mol_type = other DNA
gatccatgtctgatgtactggttttagagctagaaatagcaagttaaaataaggctagtccgttatcaacttgaaaaagtggcaccgagtcggtgcctggccttccgagtcttccactgcacacagtacatcagacat

SEQ ID NO: 29518 - DNA, 138 bp, synthetic construct
  source 1..138: mol_type = other DNA
tttcctctcgggatttcttggttttagagctagaaatagcaagttaaaataaggctagtccgttatcaacttgaaaaagtggcaccgagtcggtgcgtggaagactcggaaggccaggccacccaagaaatcccgaga

SEQ ID NO: 29519 - DNA, 138 bp, synthetic construct; identical to SEQ ID NO: 29517
  source 1..138: mol_type = other DNA

SEQ ID NO: 29520 - DNA, 138 bp, synthetic construct; identical to SEQ ID NO: 29518
  source 1..138: mol_type = other DNA

SEQ ID NO: 29521 - DNA, 212 bp, synthetic construct
  source 1..212: mol_type = other DNA
ttggatccatgtctgatgtactggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctctggccttccgagtcttccactgcacacagtacatcagacat

SEQ ID NO: 29522 - DNA, 212 bp, synthetic construct; identical to SEQ ID NO: 29521
  source 1..212: mol_type = other DNA

SEQ ID NO: 29523 - DNA, 138 bp, synthetic construct
  source 1..138: mol_type = other DNA
ggatccatgtctgatgtactgttttagagctagaaatagcaagttaaaataaggctagtccgttatcaacttgaaaaagtggcaccgagtcggtgctggccttccgagtcttccactgcacacagtacatcagacatg

SEQ ID NO: 29524 - DNA, 138 bp, synthetic construct; identical to SEQ ID NO: 29523
  source 1..138: mol_type = other DNA

SEQ ID NO: 29525 - DNA, 138 bp, synthetic construct
  source 1..138: mol_type = other DNA
ctttcctctcgggatttcttgttttagagctagaaatagcaagttaaaataaggctagtccgttatcaacttgaaaaagtggcaccgagtcggtgctggaagactcggaaggccaggccacccaagaaatcccgagag

SEQ ID NO: 29526 - DNA, 138 bp, synthetic construct; identical to SEQ ID NO: 29525
  source 1..138: mol_type = other DNA

SEQ ID NO: 29527 - DNA, 138 bp, synthetic construct; identical to SEQ ID NO: 29525
  source 1..138: mol_type = other DNA

SEQ ID NO: 29528 - DNA, 138 bp, synthetic construct; identical to SEQ ID NO: 29525
  source 1..138: mol_type = other DNA

SEQ ID NO: 29529 - DNA, 139 bp, synthetic construct
  source 1..139: mol_type = other DNA
tgctttcctctcgggatttctgttttagtactctggaaacagaatctactaaaacaaggcaaaatgccgtgtttatctcgtcaacttgttggcgagaggaagactcggaaggccaggccacccaagaaatcccgagagg

SEQ ID NO: 29530 - DNA, 139 bp, synthetic construct; identical to SEQ ID NO: 29529
  source 1..139: mol_type = other DNA

SEQ ID NO: 29531 - DNA, 138 bp, synthetic construct
  source 1..138: mol_type = other DNA
gctttcctctcgggatttctgttttagagctagaaatagcaagttaaaataaggctagtccgttatcaacttgaaaaagtggcaccgagtcggtgcggaagactcggaaggccaggccacccaagaaatcccgagagg

SEQ ID NO: 29532 - DNA, 138 bp, synthetic construct; identical to SEQ ID NO: 29531
  source 1..138: mol_type = other DNA

SEQ ID NO: 29533 - DNA, 138 bp, synthetic construct; identical to SEQ ID NO: 29531
  source 1..138: mol_type = other DNA

SEQ ID NO: 29534 - DNA, 138 bp, synthetic construct
  source 1..138: mol_type = other DNA
tggatccatgtctgatgtacgttttagagctagaaatagcaagttaaaataaggctagtccgttatcaacttgaaaaagtggcaccgagtcggtgcggccttccgagtcttccactgcacacagtacatcagacatgg

SEQ ID NO: 29535 - DNA, 138 bp, synthetic construct; identical to SEQ ID NO: 29531
  source 1..138: mol_type = other DNA

SEQ ID NO: 29536 - DNA, 138 bp, synthetic construct; identical to SEQ ID NO: 29534
  source 1..138: mol_type = other DNA

SEQ ID NO: 29537 - DNA, 141 bp, synthetic construct
  source 1..141: mol_type = other DNA
gcctgctttcctctcgggatttcgttttagtactctggaaacagaatctactaaaacaaggcaaaatgccgtgtttatctcgtcaacttgttggcgagagaagactcggaaggccaggccacccaagaaatcccgagagga

SEQ ID NO: 29538 - DNA, 139 bp, synthetic construct
  source 1..139: mol_type = other DNA
ctgctttcctctcgggatttcgttttagtactctggaaacagaatctactaaaacaaggcaaaatgccgtgtttatctcgtcaacttgttggcgagagaagactcggaaggccaggccacccaagaaatcccgagagga

SEQ ID NO: 29539 - DNA, 141 bp, synthetic construct; identical to SEQ ID NO: 29537
  source 1..141: mol_type = other DNA

SEQ ID NO: 29540 - DNA, 139 bp, synthetic construct; identical to SEQ ID NO: 29538
  source 1..139: mol_type = other DNA

SEQ ID NO: 29541 - DNA, 139 bp, synthetic construct; identical to SEQ ID NO: 29538
  source 1..139: mol_type = other DNA

SEQ ID NO: 29542 - DNA, 139 bp, synthetic construct; identical to SEQ ID NO: 29538
  source 1..139: mol_type = other DNA

SEQ ID NO: 29543 - DNA, 138 bp, synthetic construct
  source 1..138: mol_type = other DNA
ttggatccatgtctgatgtagttttagagctagaaatagcaagttaaaataaggctagtccgttatcaacttgaaaaagtggcaccgagtcggtgcgccttccgagtcttccactgcacacagtacatcagacatgga

SEQ ID NO: 29544 - DNA, 138 bp, synthetic construct; identical to SEQ ID NO: 29543
  source 1..138: mol_type = other DNA

SEQ ID NO: 29545 - DNA, 138 bp, synthetic construct
  source 1..138: mol_type = other DNA
tgctttcctctcgggatttcgttttagagctagaaatagcaagttaaaataaggctagtccgttatcaacttgaaaaagtggcaccgagtcggtgcgaagactcggaaggccaggccacccaagaaatcccgagagga

SEQ ID NO: 29546 - DNA, 138 bp, synthetic construct; identical to SEQ ID NO: 29545
  source 1..138: mol_type = other DNA

SEQ ID NO: 29547 - DNA, 139 bp, synthetic construct
  source 1..139: mol_type = other DNA
cctgctttcctctcgggatttgttttagtactctggaaacagaatctactaaaacaaggcaaaatgccgtgtttatctcgtcaacttgttggcgagaaagactcggaaggccaggccacccaagaaatcccgagaggaa

SEQ ID NO: 29548 - DNA, 138 bp, synthetic construct
  source 1..138: mol_type = other DNA
cttggatccatgtctgatgtgttttagagctagaaatagcaagttaaaataaggctagtccgttatcaacttgaaaaagtggcaccgagtcggtgcccttccgagtcttccactgcacacagtacatcagacatggat

SEQ ID NO: 29549 - DNA, 138 bp, synthetic construct
  source 1..138: mol_type = other DNA
ctgctttcctctcgggatttgttttagagctagaaatagcaagttaaaataaggctagtccgttatcaacttgaaaaagtggcaccgagtcggtgcaagactcggaaggccaggccacccaagaaatcccgagaggaa

SEQ ID NO: 29550 - DNA, 138 bp, synthetic construct
  source 1..138: mol_type = other DNA
gcttggatccatgtctgatggttttagagctagaaatagcaagttaaaataaggctagtccgttatcaacttgaaaaagtggcaccgagtcggtgccttccgagtcttccactgcacacagtacatcagacatggatc

SEQ ID NO: 29551 - DNA, 138 bp, synthetic construct
  source 1..138: mol_type = other DNA
cctgctttcctctcgggattgttttagagctagaaatagcaagttaaaataaggctagtccgttatcaacttgaaaaagtggcaccgagtcggtgcagactcggaaggccaggccacccaagaaatcccgagaggaaa

SEQ ID NO: 29552 - DNA, 138 bp, synthetic construct
  source 1..138: mol_type = other DNA
ggcttggatccatgtctgatgttttagagctagaaatagcaagttaaaataaggctagtccgttatcaacttgaaaaagtggcaccgagtcggtgcttccgagtcttccactgcacacagtacatcagacatggatcc

SEQ ID NO: 29553 - DNA, 138 bp, synthetic construct
  source 1..138: mol_type = other DNA
gcctgctttcctctcgggatgttttagagctagaaatagcaagttaaaataaggctagtccgttatcaacttgaaaaagtggcaccgagtcggtgcgactcggaaggccaggccacccaagaaatcccgagaggaaag

SEQ ID NO: 29554 - DNA, 138 bp, synthetic construct
  source 1..138: mol_type = other DNA
gggcttggatccatgtctgagttttagagctagaaatagcaagttaaaataaggctagtccgttatcaacttgaaaaagtggcaccgagtcggtgctccgagtcttccactgcacacagtacatcagacatggatcca

SEQ ID NO: 29555 - DNA, 138 bp, synthetic construct; identical to SEQ ID NO: 29554
  source 1..138: mol_type = other DNA

SEQ ID NO: 29556 - DNA, 138 bp, synthetic construct
  source 1..138: mol_type = other DNA
ggcctgctttcctctcgggagttttagagctagaaatagcaagttaaaataaggctagtccgttatcaacttgaaaaagtggcaccgagtcggtgcactcggaaggccaggccacccaagaaatcccgagaggaaagc

SEQ ID NO: 29557 - DNA, 212 bp, synthetic construct
  source 1..212: mol_type = other DNA
catgggcttggatccatgtctgagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttccgagtcttccactgcacacagtacatcagacatggatcca

SEQ ID NO: 29558 - DNA, 212 bp, synthetic construct; identical to SEQ ID NO: 29557
  source 1..212: mol_type = other DNA

SEQ ID NO: 29559 - DNA, 138 bp, synthetic construct
  source 1..138: mol_type = other DNA
tgggcttggatccatgtctggttttagagctagaaatagcaagttaaaataaggctagtccgttatcaacttgaaaaagtggcaccgagtcggtgcccgagtcttccactgcacacagtacatcagacatggatccaa

SEQ ID NO: 29560 - DNA, 138 bp, synthetic construct; identical to SEQ ID NO: 29559
  source 1..138: mol_type = other DNA

SEQ ID NO: 29561 - DNA, 138 bp, synthetic construct
  source 1..138: mol_type = other DNA
tggcctgctttcctctcggggttttagagctagaaatagcaagttaaaataaggctagtccgttatcaacttgaaaaagtggcaccgagtcggtgcctcggaaggccaggccacccaagaaatcccgagaggaaagca

SEQ ID NO: 29562 - DNA, 212 bp, synthetic construct
  source 1..212: mol_type = other DNA
ggctggcctgctttcctctcggggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctctcggaaggccaggccacccaagaaatcccgagaggaaagca

SEQ ID NO: 29563 - DNA, 212 bp, synthetic construct; identical to SEQ ID NO: 29562
  source 1..212: mol_type = other DNA

SEQ ID NO: 29564 - DNA, 138 bp, synthetic construct
  source 1..138: mol_type = other DNA
atgggcttggatccatgtctgttttagagctagaaatagcaagttaaaataaggctagtccgttatcaacttgaaaaagtggcaccgagtcggtgccgagtcttccactgcacacagtacatcagacatggatccaag

SEQ ID NO: 29565 - DNA, 138 bp, synthetic construct
  source 1..138: mol_type = other DNA
ctggcctgctttcctctcgggttttagagctagaaatagcaagttaaaataaggctagtccgttatcaacttgaaaaagtggcaccgagtcggtgctcggaaggccaggccacccaagaaatcccgagaggaaagcag

SEQ ID NO: 29566 - DNA, 138 bp, synthetic construct
  source 1..138: mol_type = other DNA
catgggcttggatccatgtcgttttagagctagaaatagcaagttaaaataaggctagtccgttatcaacttgaaaaagtggcaccgagtcggtgcgagtcttccactgcacacagtacatcagacatggatccaagc

SEQ ID NO: 29567 - DNA, 138 bp, synthetic construct
  source 1..138: mol_type = other DNA
gctggcctgctttcctctcggttttagagctagaaatagcaagttaaaataaggctagtccgttatcaacttgaaaaagtggcaccgagtcggtgccggaaggccaggccacccaagaaatcccgagaggaaagcagg

SEQ ID NO: 29568 - DNA, 138 bp, synthetic construct; identical to SEQ ID NO: 29566
  source 1..138: mol_type = other DNA

SEQ ID NO: 29569 - DNA, 138 bp, synthetic construct; identical to SEQ ID NO: 29567
  source 1..138: mol_type = other DNA

SEQ ID NO: 29570 - DNA, 138 bp, synthetic construct
  source 1..138: mol_type = other DNA
acatgggcttggatccatgtgttttagagctagaaatagcaagttaaaataaggctagtccgttatcaacttgaaaaagtggcaccgagtcggtgcagtcttccactgcacacagtacatcagacatggatccaagcc

SEQ ID NO: 29571 - DNA, 138 bp, synthetic construct; identical to SEQ ID NO: 29570
  source 1..138: mol_type = other DNA

SEQ ID NO: 29572 - DNA, 138 bp, synthetic construct
  source 1..138: mol_type = other DNA
ggctggcctgctttcctctcgttttagagctagaaatagcaagttaaaataaggctagtccgttatcaacttgaaaaagtggcaccgagtcggtgcggaaggccaggccacccaagaaatcccgagaggaaagcaggc

SEQ ID NO: 29573 - DNA, 138 bp, synthetic construct; identical to SEQ ID NO: 29572
  source 1..138: mol_type = other DNA

SEQ ID NO: 29574 - DNA, 138 bp, synthetic construct; identical to SEQ ID NO: 29572
  source 1..138: mol_type = other DNA

SEQ ID NO: 29575 - DNA, 138 bp, synthetic construct; identical to SEQ ID NO: 29572
  source 1..138: mol_type = other DNA

SEQ ID NO: 29576 - DNA, 145 bp, synthetic construct
  source 1..145: mol_type = other DNA
gcagcaggaaaagatggcgctcatgttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 29577 - DNA, 96 bp, synthetic construct
  source 1..96: mol_type = other DNA
aggaaaagatggcgctcattgttttagagctagaaatagcaagttaaaataaggctagtccgttatcaacttgaaaaagtggcaccgagtcggtgc

SEQ ID NO: 29578 - DNA, 170 bp, synthetic construct
  source 1..170: mol_type = other DNA
agcaggaaaagatggcgctcattgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29579 - DNA, 97 bp, synthetic construct
  source 1..97: mol_type = other DNA
ctgactcagtggtgatgagctgttttagtactctggaaacagaatctactaaaacaaggcaaaatgccgtgtttatctcgtcaacttgttggcgaga

SEQ ID NO: 29580 - DNA, 97 bp, synthetic construct
  source 1..97: mol_type = other DNA
tgactcagtggtgatgagcttgttttagtactctggaaacagaatctactaaaacaaggcaaaatgccgtgtttatctcgtcaacttgttggcgaga

SEQ ID NO: 29581 - DNA, 96 bp, synthetic construct
  source 1..96: mol_type = other DNA
ggtgatgagctttgagttttgttttagagctagaaatagcaagttaaaataaggctagtccgttatcaacttgaaaaagtggcaccgagtcggtgc

SEQ ID NO: 29582 - DNA, 96 bp, synthetic construct
  source 1..96: mol_type = other DNA
ggaaaagatggcgctcattggttttagagctagaaatagcaagttaaaataaggctagtccgttatcaacttgaaaaagtggcaccgagtcggtgc

SEQ ID NO: 29583 - DNA, 97 bp, synthetic construct; identical to SEQ ID NO: 29579
  source 1..97: mol_type = other DNA

SEQ ID NO: 29584 - DNA, 96 bp, synthetic construct; identical to SEQ ID NO: 29582
  source 1..96: mol_type = other DNA

SEQ ID NO: 29585 - DNA, 96 bp, synthetic construct
  source 1..96: mol_type = other DNA
ctcagtggtgatgagctttggttttagagctagaaatagcaagttaaaataaggctagtccgttatcaacttgaaaaagtggcaccgagtcggtgc

SEQ ID NO: 29586 - DNA, 96 bp, synthetic construct
  source 1..96: mol_type = other DNA
gaaaagatggcgctcattgtgttttagagctagaaatagcaagttaaaataaggctagtccgttatcaacttgaaaaagtggcaccgagtcggtgc

SEQ ID NO: 29587 - DNA, 96 bp, synthetic construct
  source 1..96: mol_type = other DNA
gtgatgagctttgagttttcgttttagagctagaaatagcaagttaaaataaggctagtccgttatcaacttgaaaaagtggcaccgagtcggtgc

SEQ ID NO: 29588 - DNA, 99 bp, synthetic construct
  source 1..99: mol_type = other DNA
ctctgactcagtggtgatgagctgttttagtactctggaaacagaatctactaaaacaaggcaaaatgccgtgtttatctcgtcaacttgttggcgaga

SEQ ID NO: 29589 - DNA, 97 bp, synthetic construct; identical to SEQ ID NO: 29579
  source 1..97: mol_type = other DNA

SEQ ID NO: 29590 - DNA, 96 bp, synthetic construct
  source 1..96: mol_type = other DNA
aaagatggcgctcattgtgcgttttagagctagaaatagcaagttaaaataaggctagtccgttatcaacttgaaaaagtggcaccgagtcggtgc

SEQ ID NO: 29591 - DNA, 96 bp, synthetic construct
  source 1..96: mol_type = other DNA
aaaagatggcgctcattgtggttttagagctagaaatagcaagttaaaataaggctagtccgttatcaacttgaaaaagtggcaccgagtcggtgc

SEQ ID NO: 29592 - DNA, 96 bp, synthetic construct
  source 1..96: mol_type = other DNA
actcagtggtgatgagctttgttttagagctagaaatagcaagttaaaataaggctagtccgttatcaacttgaaaaagtggcaccgagtcggtgc

SEQ ID NO: 29593 - DNA, 96 bp, synthetic construct
  source 1..96: mol_type = other DNA
tcctagtgcctctgactcaggttttagagctagaaatagcaagttaaaataaggctagtccgttatcaacttgaaaaagtggcaccgagtcggtgc

SEQ ID NO: 29594 - DNA, 96 bp, synthetic construct
  source 1..96: mol_type = other DNA
tgatgagctttgagttttctgttttagagctagaaatagcaagttaaaataaggctagtccgttatcaacttgaaaaagtggcaccgagtcggtgc

SEQ ID NO: 29595 - DNA, 96 bp, synthetic construct; identical to SEQ ID NO: 29585
  source 1..96: mol_type = other DNA

SEQ ID NO: 29596 - DNA, 170 bp, synthetic construct
  source 1..170: mol_type = other DNA
ggaaaagatggcgctcattgtgcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29597 - DNA, 99 bp, synthetic construct; identical to SEQ ID NO: 29588
  source 1..99: mol_type = other DNA

SEQ ID NO: 29598 - DNA, 97 bp, synthetic construct
  source 1..97: mol_type = other DNA
agttttctttcttcttttcatgttttagtactctggaaacagaatctactaaaacaaggcaaaatgccgtgtttatctcgtcaacttgttggcgaga

SEQ ID NO: 29599 - DNA, 97 bp, synthetic construct
  source 1..97: mol_type = other DNA
ttcttttcatcccagcttgcagttttagtactctggaaacagaatctactaaaacaaggcaaaatgccgtgtttatctcgtcaacttgttggcgaga

SEQ ID NO: 29600 - DNA, 97 bp, synthetic construct; identical to SEQ ID NO: 29580
  source 1..97: mol_type = other DNA

SEQ ID NO: 29601 - DNA, 97 bp, synthetic construct
  source 1..97: mol_type = other DNA
aaaagatggcgctcattgtgcgttttagtactctggaaacagaatctactaaaacaaggcaaaatgccgtgtttatctcgtcaacttgttggcgaga

SEQ ID NO: 29602 - DNA, 96 bp, synthetic construct; identical to SEQ ID NO: 29592
  source 1..96: mol_type = other DNA

SEQ ID NO: 29603 - DNA, 96 bp, synthetic construct
  source 1..96: mol_type = other DNA
gatgagctttgagttttcttgttttagagctagaaatagcaagttaaaataaggctagtccgttatcaacttgaaaaagtggcaccgagtcggtgc

SEQ ID NO: 29604 - DNA, 96 bp, synthetic construct; identical to SEQ ID NO: 29590
  source 1..96: mol_type = other DNA

SEQ ID NO: 29605 - DNA, 97 bp, synthetic construct
  source 1..97: mol_type = other DNA
aagatggcgctcattgtgcctgttttagtactctggaaacagaatctactaaaacaaggcaaaatgccgtgtttatctcgtcaacttgttggcgaga

SEQ ID NO: 29606 - DNA, 97 bp, synthetic construct; identical to SEQ ID NO: 29598
  source 1..97: mol_type = other DNA

SEQ ID NO: 29607 - DNA, 97 bp, synthetic construct; identical to SEQ ID NO: 29605
  source 1..97: mol_type = other DNA

SEQ ID NO: 29608 - DNA, 96 bp, synthetic construct
  source 1..96: mol_type = other DNA
atgagctttgagttttctttgttttagagctagaaatagcaagttaaaataaggctagtccgttatcaacttgaaaaagtggcaccgagtcggtgc

SEQ ID NO: 29609 - DNA, 96 bp, synthetic construct
  source 1..96: mol_type = other DNA
aagatggcgctcattgtgccgttttagagctagaaatagcaagttaaaataaggctagtccgttatcaacttgaaaaagtggcaccgagtcggtgc

SEQ ID NO: 29610 - DNA, 97 bp, synthetic construct; identical to SEQ ID NO: 29605
  source 1..97: mol_type = other DNA

SEQ ID NO: 29611 - DNA, 96 bp, synthetic construct
  source 1..96: mol_type = other DNA
tgagctttgagttttctttcgttttagagctagaaatagcaagttaaaataaggctagtccgttatcaacttgaaaaagtggcaccgagtcggtgc

SEQ ID NO: 29612 - DNA, 96 bp, synthetic construct
  source 1..96: mol_type = other DNA
agatggcgctcattgtgcctgttttagagctagaaatagcaagttaaaataaggctagtccgttatcaacttgaaaaagtggcaccgagtcggtgc

SEQ ID NO: 29613 - DNA, 96 bp, synthetic construct
  source 1..96: mol_type = other DNA
gagctttgagttttctttctgttttagagctagaaatagcaagttaaaataaggctagtccgttatcaacttgaaaaagtggcaccgagtcggtgc

SEQ ID NO: 29614 - DNA, 96 bp, synthetic construct
  source 1..96: mol_type = other DNA
gatggcgctcattgtgcctggttttagagctagaaatagcaagttaaaataaggctagtccgttatcaacttgaaaaagtggcaccgagtcggtgc

SEQ ID NO: 29615 - DNA, 96 bp, synthetic construct
  source 1..96: mol_type = other DNA
ttctttcttcttttcatcccgttttagagctagaaatagcaagttaaaataaggctagtccgttatcaacttgaaaaagtggcaccgagtcggtgc

SEQ ID NO: 29616 - DNA, 96 bp, synthetic construct
  source 1..96: mol_type = other DNA
agctttgagttttctttcttgttttagagctagaaatagcaagttaaaataaggctagtccgttatcaacttgaaaaagtggcaccgagtcggtgc

SEQ ID NO: 29617 - DNA, 96 bp, synthetic construct
  source 1..96: mol_type = other DNA
atggcgctcattgtgcctgggttttagagctagaaatagcaagttaaaataaggctagtccgttatcaacttgaaaaagtggcaccgagtcggtgc

SEQ ID NO: 29618 - DNA, 170 bp, synthetic construct
  source 1..170: mol_type = other DNA
aaagatggcgctcattgtgcctggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29619 - DNA, 170 bp, synthetic construct; identical to SEQ ID NO: 29618
  source 1..170: mol_type = other DNA

SEQ ID NO: 29620 - DNA, 145 bp, synthetic construct; identical to SEQ ID NO: 29576
  source 1..145: mol_type = other DNA

SEQ ID NO: 29621 - DNA, 96 bp, synthetic construct
  source 1..96: mol_type = other DNA
tttctttcttcttttcatccgttttagagctagaaatagcaagttaaaataaggctagtccgttatcaacttgaaaaagtggcaccgagtcggtgc

SEQ ID NO: 29622 - DNA, 96 bp, synthetic construct
  source 1..96: mol_type = other DNA
gctttgagttttctttcttcgttttagagctagaaatagcaagttaaaataaggctagtccgttatcaacttgaaaaagtggcaccgagtcggtgc

SEQ ID NO: 29623 - DNA, 96 bp, synthetic construct
  source 1..96: mol_type = other DNA
tggcgctcattgtgcctggcgttttagagctagaaatagcaagttaaaataaggctagtccgttatcaacttgaaaaagtggcaccgagtcggtgc

SEQ ID NO: 29624 - DNA, 170 bp, synthetic construct
  source 1..170: mol_type = other DNA
tgagctttgagttttctttcttcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29625 - DNA, 170 bp, synthetic construct; identical to SEQ ID NO: 29618
  source 1..170: mol_type = other DNA

SEQ ID NO: 29626 - DNA, 170 bp, synthetic construct; identical to SEQ ID NO: 29618
  source 1..170: mol_type = other DNA

SEQ ID NO: 29627 - DNA, 170 bp, synthetic construct; identical to SEQ ID NO: 29624
  source 1..170: mol_type = other DNA

SEQ ID NO: 29628 - DNA, 170 bp, synthetic construct; identical to SEQ ID NO: 29618
  source 1..170: mol_type = other DNA

SEQ ID NO: 29629 - DNA, 97 bp, synthetic construct; identical to SEQ ID NO: 29598
  source 1..97: mol_type = other DNA

SEQ ID NO: 29630 - DNA, 97 bp, synthetic construct
  source 1..97: mol_type = other DNA
gttttctttcttcttttcatcgttttagtactctggaaacagaatctactaaaacaaggcaaaatgccgtgtttatctcgtcaacttgttggcgaga

SEQ ID NO: 29631 - DNA, 96 bp, synthetic construct
  source 1..96: mol_type = other DNA
ctttgagttttctttcttctgttttagagctagaaatagcaagttaaaataaggctagtccgttatcaacttgaaaaagtggcaccgagtcggtgc

SEQ ID NO: 29632 - DNA, 96 bp, synthetic construct
  source 1..96: mol_type = other DNA
ggcgctcattgtgcctggcagttttagagctagaaatagcaagttaaaataaggctagtccgttatcaacttgaaaaagtggcaccgagtcggtgc

SEQ ID NO: 29633 - DNA, 97 bp, synthetic construct; identical to SEQ ID NO: 29598
  source 1..97: mol_type = other DNA

SEQ ID NO: 29634 - DNA, 96 bp, synthetic construct; identical to SEQ ID NO: 29615
  source 1..96: mol_type = other DNA

SEQ ID NO: 29635 - DNA, 96 bp, synthetic construct
  source 1..96: mol_type = other DNA
cgctcattgtgcctggcaacgttttagagctagaaatagcaagttaaaataaggctagtccgttatcaacttgaaaaagtggcaccgagtcggtgc

SEQ ID NO: 29636 - DNA, 96 bp, synthetic construct
  source 1..96: mol_type = other DNA
tttgagttttctttcttcttgttttagagctagaaatagcaagttaaaataaggctagtccgttatcaacttgaaaaagtggcaccgagtcggtgc

SEQ ID NO: 29637 - DNA, 96 bp, synthetic construct
  source 1..96: mol_type = other DNA
gcgctcattgtgcctggcaagttttagagctagaaatagcaagttaaaataaggctagtccgttatcaacttgaaaaagtggcaccgagtcggtgc

SEQ ID NO: 29638 - DNA, 99 bp, synthetic construct; identical to SEQ ID NO: 29588
  source 1..99: mol_type = other DNA

SEQ ID NO: 29639 - DNA, 97 bp, synthetic construct; identical to SEQ ID NO: 29598
  source 1..97: mol_type = other DNA

SEQ ID NO: 29640 - DNA, 96 bp, synthetic construct; identical to SEQ ID NO: 29621
  source 1..96: mol_type = other DNA

SEQ ID NO: 29641 - DNA, 96 bp, synthetic construct
  source 1..96: mol_type = other DNA
cttttcatcccagcttgcacgttttagagctagaaatagcaagttaaaataaggctagtccgttatcaacttgaaaaagtggcaccgagtcggtgc

SEQ ID NO: 29642 - DNA, 96 bp, synthetic construct
  source 1..96: mol_type = other DNA
ttgagttttctttcttctttgttttagagctagaaatagcaagttaaaataaggctagtccgttatcaacttgaaaaagtggcaccgagtcggtgc

SEQ ID NO: 29643 - DNA, 96 bp, synthetic construct; identical to SEQ ID NO: 29635
  source 1..96: mol_type = other DNA

SEQ ID NO: 29644 - DNA, 96 bp, synthetic construct; identical to SEQ ID NO: 29635
  source 1..96: mol_type = other DNA

SEQ ID NO: 29645 - DNA, 96 bp, synthetic construct; identical to SEQ ID NO: 29635
  source 1..96: mol_type = other DNA

SEQ ID NO: 29646 - DNA, 96 bp, synthetic construct; identical to SEQ ID NO: 29615
  source 1..96: mol_type = other DNA

SEQ ID NO: 29647 - DNA, 96 bp, synthetic construct; identical to SEQ ID NO: 29635
  source 1..96: mol_type = other DNA

SEQ ID NO: 29648 - DNA, 170 bp, synthetic construct
  source 1..170: mol_type = other DNA
gcgctcattgtgcctggcaactggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29649 - DNA, 145 bp, synthetic construct; identical to SEQ ID NO: 29576
  source 1..145: mol_type = other DNA

SEQ ID NO: 29650 - DNA, 99 bp, synthetic construct; identical to SEQ ID NO: 29588
  source 1..99: mol_type = other DNA

SEQ ID NO: 29651 - DNA, 97 bp, synthetic construct; identical to SEQ ID NO: 29598
  source 1..97: mol_type = other DNA

SEQ ID NO: 29652 - DNA, 97 bp, synthetic construct; identical to SEQ ID NO: 29599
  source 1..97: mol_type = other DNA

SEQ ID NO: 29653 - DNA, 97 bp, synthetic construct; identical to SEQ ID NO: 29630
  source 1..97: mol_type = other DNA

SEQ ID NO: 29654 - DNA, 97 bp, synthetic construct
  source 1..97: mol_type = other DNA
ggcgctcattgtgcctggcaagttttagtactctggaaacagaatctactaaaacaaggcaaaatgccgtgtttatctcgtcaacttgttggcgaga

SEQ ID NO: 29655 - DNA, 97 bp, synthetic construct
  source 1..97: mol_type = other DNA
gctcattgtgcctggcaactggttttagtactctggaaacagaatctactaaaacaaggcaaaatgccgtgtttatctcgtcaacttgttggcgaga

SEQ ID NO: 29656 - DNA, 96 bp, synthetic construct; identical to SEQ ID NO: 29621
  source 1..96: mol_type = other DNA

SEQ ID NO: 29657 - DNA, 96 bp, synthetic construct
  source 1..96: mol_type = other DNA
tgagttttctttcttcttttgttttagagctagaaatagcaagttaaaataaggctagtccgttatcaacttgaaaaagtggcaccgagtcggtgc

SEQ ID NO: 29658 - DNA, 96 bp, synthetic construct; identical to SEQ ID NO: 29635
  source 1..96: mol_type = other DNA

SEQ ID NO: 29659 - DNA, 96 bp, synthetic construct
  source 1..96: mol_type = other DNA
gctcattgtgcctggcaactgttttagagctagaaatagcaagttaaaataaggctagtccgttatcaacttgaaaaagtggcaccgagtcggtgc

SEQ ID NO: 29660 - DNA, 170 bp, synthetic construct; identical to SEQ ID NO: 29648
  source 1..170: mol_type = other DNA

SEQ ID NO: 29661 - DNA, 170 bp, synthetic construct; identical to SEQ ID NO: 29648
  source 1..170: mol_type = other DNA

SEQ ID NO: 29662 - DNA, 97 bp, synthetic construct; identical to SEQ ID NO: 29598
  source 1..97: mol_type = other DNA

SEQ ID NO: 29663 - DNA, 97 bp, synthetic construct
  source 1..97: mol_type = other DNA
cgctcattgtgcctggcaactgttttagtactctggaaacagaatctactaaaacaaggcaaaatgccgtgtttatctcgtcaacttgttggcgaga

SEQ ID NO: 29664 - DNA, 96 bp, synthetic construct; identical to SEQ ID NO: 29615
  source 1..96: mol_type = other DNA

SEQ ID NO: 29665 - DNA, 96 bp, synthetic construct
  source 1..96: mol_type = other DNA
gagttttctttcttcttttcgttttagagctagaaatagcaagttaaaataaggctagtccgttatcaacttgaaaaagtggcaccgagtcggtgc

SEQ ID NO: 29666 - DNA, 96 bp, synthetic construct
  source 1..96: mol_type = other DNA
ctcattgtgcctggcaactggttttagagctagaaatagcaagttaaaataaggctagtccgttatcaacttgaaaaagtggcaccgagtcggtgc

SEQ ID NO: 29667 - DNA, 96 bp, synthetic construct; identical to SEQ ID NO: 29621
  source 1..96: mol_type = other DNA

SEQ ID NO: 29668 - DNA, 96 bp, synthetic construct
  source 1..96: mol_type = other DNA
agttttctttcttcttttcagttttagagctagaaatagcaagttaaaataaggctagtccgttatcaacttgaaaaagtggcaccgagtcggtgc

SEQ ID NO: 29669 - DNA, 96 bp, synthetic construct
  source 1..96: mol_type = other DNA
tcattgtgcctggcaactgggttttagagctagaaatagcaagttaaaataaggctagtccgttatcaacttgaaaaagtggcaccgagtcggtgc

SEQ ID NO: 29670 - DNA, 97 bp, synthetic construct; identical to SEQ ID NO: 29630
  source 1..97: mol_type = other DNA

SEQ ID NO: 29671 - DNA, 96 bp, synthetic construct
  source 1..96: mol_type = other DNA
cattgtgcctggcaactggtgttttagagctagaaatagcaagttaaaataaggctagtccgttatcaacttgaaaaagtggcaccgagtcggtgc

SEQ ID NO: 29672 - DNA, 96 bp, synthetic construct; identical to SEQ ID NO: 29671
  source 1..96: mol_type = other DNA

SEQ ID NO: 29673 - DNA, 96 bp, synthetic construct
  source 1..96: mol_type = other DNA
gttttctttcttcttttcatgttttagagctagaaatagcaagttaaaataaggctagtccgttatcaacttgaaaaagtggcaccgagtcggtgc

SEQ ID NO: 29674 - DNA, 97 bp, synthetic construct; identical to SEQ ID NO: 29598
  source 1..97: mol_type = other DNA

SEQ ID NO: 29675 - DNA, 97 bp, synthetic construct; identical to SEQ ID NO: 29598
  source 1..97: mol_type = other DNA

SEQ ID NO: 29676 - DNA, 96 bp, synthetic construct
  source 1..96: mol_type = other DNA
ttgtgcctggcaactggtaggttttagagctagaaatagcaagttaaaataaggctagtccgttatcaacttgaaaaagtggcaccgagtcggtgc

SEQ ID NO: 29677 - DNA, 96 bp, synthetic construct
  source 1..96: mol_type = other DNA
tgtgcctggcaactggtagcgttttagagctagaaatagcaagttaaaataaggctagtccgttatcaacttgaaaaagtggcaccgagtcggtgc

SEQ ID NO: 29678 - DNA, 96 bp, synthetic construct
  source 1..96: mol_type = other DNA
attgtgcctggcaactggtagttttagagctagaaatagcaagttaaaataaggctagtccgttatcaacttgaaaaagtggcaccgagtcggtgc

SEQ ID NO: 29679 - DNA, 96 bp, synthetic construct; identical to SEQ ID NO: 29615
  source 1..96: mol_type = other DNA

SEQ ID NO: 29680 - DNA, 96 bp, synthetic construct; identical to SEQ ID NO: 29671
  source 1..96: mol_type = other DNA

SEQ ID NO: 29681 - DNA, 96 bp, synthetic construct
  source 1..96: mol_type = other DNA
ttttctttcttcttttcatcgttttagagctagaaatagcaagttaaaataaggctagtccgttatcaacttgaaaaagtggcaccgagtcggtgc

SEQ ID NO: 29682 - DNA, 170 bp, synthetic construct; identical to SEQ ID NO: 29648
  source 1..170: mol_type = other DNA

SEQ ID NO: 29683 - DNA, 170 bp, synthetic construct; identical to SEQ ID NO: 29648
  source 1..170: mol_type = other DNA

SEQ ID NO: 29684 - DNA, 145 bp, synthetic construct; identical to SEQ ID NO: 29576
  source 1..145: mol_type = other DNA

SEQ ID NO: 29685 - DNA, 97 bp, synthetic construct
  source 1..97: mol_type = other DNA
attgtgcctggcaactggtaggttttagtactctggaaacagaatctactaaaacaaggcaaaatgccgtgtttatctcgtcaacttgttggcgaga

SEQ ID NO: 29686 - DNA, 97 bp, synthetic construct; identical to SEQ ID NO: 29685
  source 1..97: mol_type = other DNA

SEQ ID NO: 29687 - DNA, 96 bp, synthetic construct; identical to SEQ ID NO: 29621
  source 1..96: mol_type = other DNA

SEQ ID NO: 29688 - DNA, 96 bp, synthetic construct; identical to SEQ ID NO: 29621
  source 1..96: mol_type = other DNA

SEQ ID NO: 29689 - DNA, 96 bp, synthetic construct; identical to SEQ ID NO: 29676
  source 1..96: mol_type = other DNA

SEQ ID NO: 29690 - DNA, 96 bp, synthetic construct; identical to SEQ ID NO: 29676
  source 1..96: mol_type = other DNA

SEQ ID NO: 29691 - DNA, 170 bp, synthetic construct; identical to SEQ ID NO: 29648
  source 1..170: mol_type = other DNA

SEQ ID NO: 29692 - DNA, 170 bp, synthetic construct; identical to SEQ ID NO: 29648
  source 1..170: mol_type = other DNA

SEQ ID NO: 29693 - DNA, 97 bp, synthetic construct
  source 1..97: mol_type = other DNA
ttgtgcctggcaactggtagcgttttagtactctggaaacagaatctactaaaacaaggcaaaatgccgtgtttatctcgtcaacttgttggcgaga

SEQ ID NO: 29694 - DNA, 96 bp, synthetic construct; identical to SEQ ID NO: 29615
  source 1..96: mol_type = other DNA

SEQ ID NO: 29695 - DNA, 96 bp, synthetic construct; identical to SEQ ID NO: 29677
  source 1..96: mol_type = other DNA

SEQ ID NO: 29696 - DNA, 96 bp, synthetic construct; identical to SEQ ID NO: 29615
  source 1..96: mol_type = other DNA

SEQ ID NO: 29697 - DNA, 96 bp, synthetic construct; identical to SEQ ID NO: 29677
  source 1..96: mol_type = other DNA

SEQ ID NO: 29698 - DNA, 170 bp, synthetic construct
  source 1..170: mol_type = other DNA
gagttttctttcttcttttcatcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29699 - DNA, 170 bp, synthetic construct; identical to SEQ ID NO: 29698
  source 1..170: mol_type = other DNA

SEQ ID NO: 29700 - DNA, 96 bp, synthetic construct; identical to SEQ ID NO: 29621
  source 1..96: mol_type = other DNA

SEQ ID NO: 29701 - DNA, 96 bp, synthetic construct
  source 1..96: mol_type = other DNA
tctttcttcttttcatcccagttttagagctagaaatagcaagttaaaataaggctagtccgttatcaacttgaaaaagtggcaccgagtcggtgc

SEQ ID NO: 29702 - DNA, 96 bp, synthetic construct; identical to SEQ ID NO: 29677
  source 1..96: mol_type = other DNA

SEQ ID NO: 29703 - DNA, 96 bp, synthetic construct; identical to SEQ ID NO: 29677
  source 1..96: mol_type = other DNA

SEQ ID NO: 29704 - DNA, 96 bp, synthetic construct
  source 1..96: mol_type = other DNA
gtgcctggcaactggtagctgttttagagctagaaatagcaagttaaaataaggctagtccgttatcaacttgaaaaagtggcaccgagtcggtgc

SEQ ID NO: 29705 - DNA, 96 bp, synthetic construct; identical to SEQ ID NO: 29704
  source 1..96: mol_type = other DNA

SEQ ID NO: 29706 - DNA, 97 bp, synthetic construct
  source 1..97: mol_type = other DNA
gtgcctggcaactggtagctggttttagtactctggaaacagaatctactaaaacaaggcaaaatgccgtgtttatctcgtcaacttgttggcgaga

SEQ ID NO: 29707 - DNA, 97 bp, synthetic construct; identical to SEQ ID NO: 29706
  source 1..97: mol_type = other DNA

SEQ ID NO: 29708 - DNA, 96 bp, synthetic construct
  source 1..96: mol_type = other DNA
tgcctggcaactggtagctggttttagagctagaaatagcaagttaaaataaggctagtccgttatcaacttgaaaaagtggcaccgagtcggtgc

SEQ ID NO: 29709 - DNA, 96 bp, synthetic construct
  source 1..96: mol_type = other DNA
gcctggcaactggtagctgggttttagagctagaaatagcaagttaaaataaggctagtccgttatcaacttgaaaaagtggcaccgagtcggtgc

SEQ ID NO: 29710 - DNA, 96 bp, synthetic construct; identical to SEQ ID NO: 29708
  source 1..96: mol_type = other DNA

SEQ ID NO: 29711 - DNA, 96 bp, synthetic construct; identical to SEQ ID NO: 29615
  source 1..96: mol_type = other DNA

SEQ ID NO: 29712 - DNA, 96 bp, synthetic construct; identical to SEQ ID NO: 29704
  source 1..96: mol_type = other DNA

SEQ ID NO: 29713 - DNA, 96 bp, synthetic construct
  source 1..96: mol_type = other DNA
ctttcttcttttcatcccaggttttagagctagaaatagcaagttaaaataaggctagtccgttatcaacttgaaaaagtggcaccgagtcggtgc

SEQ ID NO: 29714 - DNA, 99 bp, synthetic construct
  source 1..99: mol_type = other DNA
ttgtgcctggcaactggtagctggttttagtactctggaaacagaatctactaaaacaaggcaaaatgccgtgtttatctcgtcaacttgttggcgaga

SEQ ID NO: 29715 - DNA, 97 bp, synthetic construct; identical to SEQ ID NO: 29706
  source 1..97: mol_type = other DNA

SEQ ID NO: 29716 - DNA, 99 bp, synthetic construct; identical to SEQ ID NO: 29714
  source 1..99: mol_type = other DNA

SEQ ID NO: 29717 - DNA, 97 bp, synthetic construct; identical to SEQ ID NO: 29706
  source 1..97: mol_type = other DNA

SEQ ID NO: 29718 - DNA, 97 bp, synthetic construct; identical to SEQ ID NO: 29706
  source 1..97: mol_type = other DNA

SEQ ID NO: 29719 - DNA, 97 bp, synthetic construct; identical to SEQ ID NO: 29706
  source 1..97: mol_type = other DNA

SEQ ID NO: 29720 - DNA, 96 bp, synthetic construct
  source 1..96: mol_type = other DNA
tttcttcttttcatcccagcgttttagagctagaaatagcaagttaaaataaggctagtccgttatcaacttgaaaaagtggcaccgagtcggtgc

SEQ ID NO: 29721 - DNA, 96 bp, synthetic construct; identical to SEQ ID NO: 29720
  source 1..96: mol_type = other DNA

SEQ ID NO: 29722 - DNA, 96 bp, synthetic construct; identical to SEQ ID NO: 29709
  source 1..96: mol_type = other DNA

SEQ ID NO: 29723 - DNA, 96 bp, synthetic construct; identical to SEQ ID NO: 29709
  source 1..96: mol_type = other DNA

SEQ ID NO: 29724 - DNA, 97 bp, synthetic construct
  source 1..97: mol_type = other DNA
cctggcaactggtagctggaggttttagtactctggaaacagaatctactaaaacaaggcaaaatgccgtgtttatctcgtcaacttgttggcgaga

SEQ ID NO: 29725 - DNA, 96 bp, synthetic construct
  source 1..96: mol_type = other DNA
ttcttcttttcatcccagctgttttagagctagaaatagcaagttaaaataaggctagtccgttatcaacttgaaaaagtggcaccgagtcggtgc

SEQ ID NO: 29726 - DNA, 96 bp, synthetic construct
  source 1..96: mol_type = other DNA
cctggcaactggtagctggagttttagagctagaaatagcaagttaaaataaggctagtccgttatcaacttgaaaaagtggcaccgagtcggtgc

SEQ ID NO: 29727 - DNA, 96 bp, synthetic construct
  source 1..96: mol_type = other DNA
tcttcttttcatcccagcttgttttagagctagaaatagcaagttaaaataaggctagtccgttatcaacttgaaaaagtggcaccgagtcggtgc

SEQ ID NO: 29728 - DNA, 96 bp, synthetic construct
  source 1..96: mol_type = other DNA
ctggcaactggtagctggaggttttagagctagaaatagcaagttaaaataaggctagtccgttatcaacttgaaaaagtggcaccgagtcggtgc

SEQ ID NO: 29729 - DNA, 96 bp, synthetic construct
  source 1..96: mol_type = other DNA
cttcttttcatcccagcttggttttagagctagaaatagcaagttaaaataaggctagtccgttatcaacttgaaaaagtggcaccgagtcggtgc

SEQ ID NO: 29730 - DNA, 96 bp, synthetic construct
  source 1..96: mol_type = other DNA
tggcaactggtagctggagggttttagagctagaaatagcaagttaaaataaggctagtccgttatcaacttgaaaaagtggcaccgagtcggtgc

SEQ ID NO: 29731 - DNA, 96 bp, synthetic construct; identical to SEQ ID NO: 29641
  source 1..96: mol_type = other DNA

SEQ ID NO: 29732 - DNA, 96 bp, synthetic construct
  source 1..96: mol_type = other DNA
ttcttttcatcccagcttgcgttttagagctagaaatagcaagttaaaataaggctagtccgttatcaacttgaaaaagtggcaccgagtcggtgc

SEQ ID NO: 29733 - DNA, 96 bp, synthetic construct
  source 1..96: mol_type = other DNA
ggcaactggtagctggaggagttttagagctagaaatagcaagttaaaataaggctagtccgttatcaacttgaaaaagtggcaccgagtcggtgc

SEQ ID NO: 29734 - DNA, 170 bp, synthetic construct
  source 1..170: mol_type = other DNA
tctttcttcttttcatcccagctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29735 - DNA, 170 bp, synthetic construct; identical to SEQ ID NO: 29734
  source 1..170: mol_type = other DNA

SEQ ID NO: 29736 - DNA, 96 bp, synthetic construct
  source 1..96: mol_type = other DNA
tcttttcatcccagcttgcagttttagagctagaaatagcaagttaaaataaggctagtccgttatcaacttgaaaaagtggcaccgagtcggtgc

SEQ ID NO: 29737 - DNA, 96 bp, synthetic construct; identical to SEQ ID NO: 29736
  source 1..96: mol_type = other DNA

SEQ ID NO: 29738 - DNA, 96 bp, synthetic construct
  source 1..96: mol_type = other DNA
gcaactggtagctggaggacgttttagagctagaaatagcaagttaaaataaggctagtccgttatcaacttgaaaaagtggcaccgagtcggtgc

SEQ ID NO: 29739 - DNA, 170 bp, synthetic construct
  source 1..170: mol_type = other DNA
ctggcaactggtagctggaggacgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29740 - DNA, 170 bp, synthetic construct; identical to SEQ ID NO: 29739
  source 1..170: mol_type = other DNA

SEQ ID NO: 29741 - DNA, 96 bp, synthetic construct; identical to SEQ ID NO: 29641
  source 1..96: mol_type = other DNA

SEQ ID NO: 29742 - DNA, 96 bp, synthetic construct
  source 1..96: mol_type = other DNA
caactggtagctggaggacagttttagagctagaaatagcaagttaaaataaggctagtccgttatcaacttgaaaaagtggcaccgagtcggtgc

SEQ ID NO: 29743 - DNA, 96 bp, synthetic construct
  source 1..96: mol_type = other DNA
ttttcatcccagcttgcactgttttagagctagaaatagcaagttaaaataaggctagtccgttatcaacttgaaaaagtggcaccgagtcggtgc

SEQ ID NO: 29744 - DNA, 96 bp, synthetic construct; identical to SEQ ID NO: 29738
  source 1..96: mol_type = other DNA

SEQ ID NO: 29745 - DNA, 96 bp, synthetic construct; identical to SEQ ID NO: 29743
  source 1..96: mol_type = other DNA

SEQ ID NO: 29746 - DNA, 96 bp, synthetic construct
  source 1..96: mol_type = other DNA
aactggtagctggaggacaggttttagagctagaaatagcaagttaaaataaggctagtccgttatcaacttgaaaaagtggcaccgagtcggtgc

SEQ ID NO: 29747 - DNA, 96 bp, synthetic construct; identical to SEQ ID NO: 29641
  source 1..96: mol_type = other DNA

SEQ ID NO: 29748 - DNA, 96 bp, synthetic construct
  source 1..96: mol_type = other DNA
tttcatcccagcttgcactggttttagagctagaaatagcaagttaaaataaggctagtccgttatcaacttgaaaaagtggcaccgagtcggtgc

SEQ ID NO: 29749 - DNA, 96 bp, synthetic construct
  source 1..96: mol_type = other DNA
gtagctggaggacagtactcgttttagagctagaaatagcaagttaaaataaggctagtccgttatcaacttgaaaaagtggcaccgagtcggtgc

SEQ ID NO: 29750 - DNA, 96 bp, synthetic construct
  source 1..96: mol_type = other DNA
tagctggaggacagtactcagttttagagctagaaatagcaagttaaaataaggctagtccgttatcaacttgaaaaagtggcaccgagtcggtgc

SEQ ID NO: 29751 - DNA, 96 bp, synthetic construct
  source 1..96: mol_type = other DNA
actggtagctggaggacagtgttttagagctagaaatagcaagttaaaataaggctagtccgttatcaacttgaaaaagtggcaccgagtcggtgc

SEQ ID NO: 29752 - DNA, 96 bp, synthetic construct; identical to SEQ ID NO: 29738
  source 1..96: mol_type = other DNA

SEQ ID NO: 29753 - DNA, 138 bp, synthetic construct
  source 1..138: mol_type = other DNA
cactggtttccgcctccaacgttttagagctagaaatagcaagttaaaataaggctagtccgttatcaacttgaaaaagtggcaccgagtcggtgccccgagaggaaagcaggccagccacaggtcggaggcggaaac

SEQ ID NO: 29754 - DNA, 138 bp, synthetic construct; identical to SEQ ID NO: 29753
  source 1..138: mol_type = other DNA

SEQ ID NO: 29755 - DNA, 139 bp, synthetic construct
  source 1..139: mol_type = other DNA
aagcaggccagccacaggttggttttagtactctggaaacagaatctactaaaacaaggcaaaatgccgtgtttatctcgtcaacttgttggcgagaatcccagcttgcactggtttccgcctccgacctgtggctggc

SEQ ID NO: 29756 - DNA, 139 bp, synthetic construct; identical to SEQ ID NO: 29755
  source 1..139: mol_type = other DNA

SEQ ID NO: 29757 - DNA, 138 bp, synthetic construct
  source 1..138: mol_type = other DNA
agcaggccagccacaggttggttttagagctagaaatagcaagttaaaataaggctagtccgttatcaacttgaaaaagtggcaccgagtcggtgcatcccagcttgcactggtttccgcctccgacctgtggctggc

SEQ ID NO: 29758 - DNA, 138 bp, synthetic construct; identical to SEQ ID NO: 29757
  source 1..138: mol_type = other DNA

SEQ ID NO: 29759 - DNA, 138 bp, synthetic construct
  source 1..138: mol_type = other DNA
gcactggtttccgcctccaagttttagagctagaaatagcaagttaaaataaggctagtccgttatcaacttgaaaaagtggcaccgagtcggtgcccgagaggaaagcaggccagccacaggtcggaggcggaaacc

SEQ ID NO: 29760 - DNA, 212 bp, synthetic construct
  source 1..212: mol_type = other DNA
gaaagcaggccagccacaggttggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctatcccagcttgcactggtttccgcctccgacctgtggctggc

SEQ ID NO: 29761 - DNA, 212 bp, synthetic construct; identical to SEQ ID NO: 29760
  source 1..212: mol_type = other DNA

SEQ ID NO: 29762 - DNA, 139 bp, synthetic construct
  source 1..139: mol_type = other DNA
aaagcaggccagccacaggttgttttagtactctggaaacagaatctactaaaacaaggcaaaatgccgtgtttatctcgtcaacttgttggcgagatcccagcttgcactggtttccgcctccgacctgtggctggcc

SEQ ID NO: 29763 - DNA, 139 bp, synthetic construct; identical to SEQ ID NO: 29762
  source 1..139: mol_type = other DNA

SEQ ID NO: 29764 - DNA, 138 bp, synthetic construct
  source 1..138: mol_type = other DNA
aagcaggccagccacaggttgttttagagctagaaatagcaagttaaaataaggctagtccgttatcaacttgaaaaagtggcaccgagtcggtgctcccagcttgcactggtttccgcctccgacctgtggctggcc

SEQ ID NO: 29765 - DNA, 138 bp, synthetic construct; identical to SEQ ID NO: 29764
  source 1..138: mol_type = other DNA

SEQ ID NO: 29766 - DNA, 138 bp, synthetic construct
  source 1..138: mol_type = other DNA
tgcactggtttccgcctccagttttagagctagaaatagcaagttaaaataaggctagtccgttatcaacttgaaaaagtggcaccgagtcggtgccgagaggaaagcaggccagccacaggtcggaggcggaaacca

SEQ ID NO: 29767 - DNA, 141 bp, synthetic construct
  source 1..141: mol_type = other DNA
aggaaagcaggccagccacaggtgttttagtactctggaaacagaatctactaaaacaaggcaaaatgccgtgtttatctcgtcaacttgttggcgagacccagcttgcactggtttccgcctccgacctgtggctggcct

SEQ ID NO: 29768 - DNA, 139 bp, synthetic construct
  source 1..139: mol_type = other DNA
gaaagcaggccagccacaggtgttttagtactctggaaacagaatctactaaaacaaggcaaaatgccgtgtttatctcgtcaacttgttggcgagacccagcttgcactggtttccgcctccgacctgtggctggcct

SEQ ID NO: 29769 - DNA, 138 bp, synthetic construct
  source 1..138: mol_type = other DNA
aaagcaggccagccacaggtgttttagagctagaaatagcaagttaaaataaggctagtccgttatcaacttgaaaaagtggcaccgagtcggtgccccagcttgcactggtttccgcctccgacctgtggctggcct

SEQ ID NO: 29770 - DNA, 138 bp, synthetic construct; identical to SEQ ID NO: 29769
  source 1..138: mol_type = other DNA

SEQ ID NO: 29771 - DNA, 138 bp, synthetic construct; identical to SEQ ID NO: 29769
  source 1..138: mol_type = other DNA

SEQ ID NO: 29772 - DNA, 138 bp, synthetic construct; identical to SEQ ID NO: 29769
  source 1..138: mol_type = other DNA

SEQ ID NO: 29773 - DNA, 138 bp, synthetic construct
  source 1..138: mol_type = other DNA
ttgcactggtttccgcctccgttttagagctagaaatagcaagttaaaataaggctagtccgttatcaacttgaaaaagtggcaccgagtcggtgcgagaggaaagcaggccagccacaggtcggaggcggaaaccag

SEQ ID NO: 29774 - DNA, 141 bp, synthetic construct
  source 1..141: mol_type = other DNA
gaggaaagcaggccagccacagggttttagtactctggaaacagaatctactaaaacaaggcaaaatgccgtgtttatctcgtcaacttgttggcgagaccagcttgcactggtttccgcctccgacctgtggctggcctg

SEQ ID NO: 29775 - DNA, 139 bp, synthetic construct
  source 1..139: mol_type = other DNA
ggaaagcaggccagccacagggttttagtactctggaaacagaatctactaaaacaaggcaaaatgccgtgtttatctcgtcaacttgttggcgagaccagcttgcactggtttccgcctccgacctgtggctggcctg

SEQ ID NO: 29776 - DNA, 139 bp, synthetic construct; identical to SEQ ID NO: 29775
  source 1..139: mol_type = other DNA

SEQ ID NO: 29777 - DNA, 139 bp, synthetic construct; identical to SEQ ID NO: 29775
  source 1..139: mol_type = other DNA

SEQ ID NO: 29778 - DNA, 138 bp, synthetic construct
  source 1..138: mol_type = other DNA
gaaagcaggccagccacagggttttagagctagaaatagcaagttaaaataaggctagtccgttatcaacttgaaaaagtggcaccgagtcggtgcccagcttgcactggtttccgcctccgacctgtggctggcctg

SEQ ID NO: 29779 - DNA, 138 bp, synthetic construct; identical to SEQ ID NO: 29778
  source 1..138: mol_type = other DNA

SEQ ID NO: 29780 - DNA, 138 bp, synthetic construct
  source 1..138: mol_type = other DNA
cttgcactggtttccgcctcgttttagagctagaaatagcaagttaaaataaggctagtccgttatcaacttgaaaaagtggcaccgagtcggtgcagaggaaagcaggccagccacaggtcggaggcggaaaccagt

SEQ ID NO: 29781 - DNA, 212 bp, synthetic construct
  source 1..212: mol_type = other DNA
cagcttgcactggtttccgcctcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctagaggaaagcaggccagccacaggtcggaggcggaaaccagt

SEQ ID NO: 29782 - DNA, 212 bp, synthetic construct; identical to SEQ ID NO: 29781
  source 1..212: mol_type = other DNA

SEQ ID NO: 29783 - DNA, 187 bp, synthetic construct
  source 1..187: mol_type = other DNA
cccagcttgcactggtttccgcctgttgtagctccctttctcatttcggaaacgaaatgagaaccgttgctacaataaggccgtctgaaaagatgtgccgcaacgctctgccccttaaagcttctgctttaaggggcatcgtttagaggaaagcaggccagccacaggtcggaggcggaaaccagtg

SEQ ID NO: 29784 - DNA, 139 bp, synthetic construct
  source 1..139: mol_type = other DNA
aggaaagcaggccagccacaggttttagtactctggaaacagaatctactaaaacaaggcaaaatgccgtgtttatctcgtcaacttgttggcgagacagcttgcactggtttccgcctccgacctgtggctggcctgc

SEQ ID NO: 29785 - DNA, 138 bp, synthetic construct
  source 1..138: mol_type = other DNA
ggaaagcaggccagccacaggttttagagctagaaatagcaagttaaaataaggctagtccgttatcaacttgaaaaagtggcaccgagtcggtgccagcttgcactggtttccgcctccgacctgtggctggcctgc

SEQ ID NO: 29786 - DNA, 138 bp, synthetic construct
  source 1..138: mol_type = other DNA
gcttgcactggtttccgcctgttttagagctagaaatagcaagttaaaataaggctagtccgttatcaacttgaaaaagtggcaccgagtcggtgcgaggaaagcaggccagccacaggtcggaggcggaaaccagtg

SEQ ID NO: 29787 - DNA, 212 bp, synthetic construct
  source 1..212: mol_type = other DNA
ccagcttgcactggtttccgcctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgaggaaagcaggccagccacaggtcggaggcggaaaccagtg

SEQ ID NO: 29788 - DNA, 212 bp, synthetic construct; identical to SEQ ID NO: 29787
  source 1..212: mol_type = other DNA

SEQ ID NO: 29789 - DNA, 139 bp, synthetic construct
  source 1..139: mol_type = other DNA
cagcttgcactggtttccgccgttttagtactctggaaacagaatctactaaaacaaggcaaaatgccgtgtttatctcgtcaacttgttggcgagaaggaaagcaggccagccacaggtcggaggcggaaaccagtgc

SEQ ID NO: 29790 - DNA, 138 bp, synthetic construct
  source 1..138: mol_type = other DNA
aggaaagcaggccagccacagttttagagctagaaatagcaagttaaaataaggctagtccgttatcaacttgaaaaagtggcaccgagtcggtgcagcttgcactggtttccgcctccgacctgtggctggcctgct

SEQ ID NO: 29791 - DNA, 138 bp, synthetic construct; identical to SEQ ID NO: 29790
  source 1..138: mol_type = other DNA

SEQ ID NO: 29792 - DNA, 138 bp, synthetic construct
  source 1..138: mol_type = other DNA
agcttgcactggtttccgccgttttagagctagaaatagcaagttaaaataaggctagtccgttatcaacttgaaaaagtggcaccgagtcggtgcaggaaagcaggccagccacaggtcggaggcggaaaccagtgc

SEQ ID NO: 29793 - DNA, 138 bp, synthetic construct
  source 1..138: mol_type = other DNA
gaggaaagcaggccagccacgttttagagctagaaatagcaagttaaaataaggctagtccgttatcaacttgaaaaagtggcaccgagtcggtgcgcttgcactggtttccgcctccgacctgtggctggcctgctt

SEQ ID NO: 29794 - DNA, 138 bp, synthetic construct; identical to SEQ ID NO: 29793
  source 1..138: mol_type = other DNA

SEQ ID NO: 29795 - DNA, 138 bp, synthetic construct; identical to SEQ ID NO: 29793
  source 1..138: mol_type = other DNA

SEQ ID NO: 29796 - DNA, 138 bp, synthetic construct; identical to SEQ ID NO: 29793
  source 1..138: mol_type = other DNA

SEQ ID NO: 29797 - DNA, 138 bp, synthetic construct
  source 1..138: mol_type = other DNA
cagcttgcactggtttccgcgttttagagctagaaatagcaagttaaaataaggctagtccgttatcaacttgaaaaagtggcaccgagtcggtgcggaaagcaggccagccacaggtcggaggcggaaaccagtgca

SEQ ID NO: 29798 - DNA, 139 bp, synthetic construct
  source 1..139: mol_type = other DNA
gagaggaaagcaggccagccagttttagtactctggaaacagaatctactaaaacaaggcaaaatgccgtgtttatctcgtcaacttgttggcgagacttgcactggtttccgcctccgacctgtggctggcctgcttt

SEQ ID NO: 29799 - DNA, 139 bp, synthetic construct; identical to SEQ ID NO: 29798
  source 1..139: mol_type = other DNA

SEQ ID NO: 29800 - DNA, 138 bp, synthetic construct
  source 1..138: mol_type = other DNA
agaggaaagcaggccagccagttttagagctagaaatagcaagttaaaataaggctagtccgttatcaacttgaaaaagtggcaccgagtcggtgccttgcactggtttccgcctccgacctgtggctggcctgcttt

SEQ ID NO: 29801 - DNA, 138 bp, synthetic construct; identical to SEQ ID NO: 29800
  source 1..138: mol_type = other DNA

SEQ ID NO: 29802 - DNA, 138 bp, synthetic construct
  source 1..138: mol_type = other DNA
ccagcttgcactggtttccggttttagagctagaaatagcaagttaaaataaggctagtccgttatcaacttgaaaaagtggcaccgagtcggtgcgaaagcaggccagccacaggtcggaggcggaaaccagtgcaa

SEQ ID NO: 29803 - DNA, 212 bp, synthetic construct
  source 1..212: mol_type = other DNA
atcccagcttgcactggtttccggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgaaagcaggccagccacaggtcggaggcggaaaccagtgcaa

SEQ ID NO: 29804 - DNA, 187 bp, synthetic construct
  source 1..187: mol_type = other DNA
tcatcccagcttgcactggtttccgttgtagctccctttctcatttcggaaacgaaatgagaaccgttgctacaataaggccgtctgaaaagatgtgccgcaacgctctgccccttaaagcttctgctttaaggggcatcgtttaaaagcaggccagccacaggtcggaggcggaaaccagtgcaag

SEQ ID NO: 29805 - DNA, 177 bp, synthetic construct
  source 1..177: mol_type = other DNA
tcccgagaggaaagcaggccagccgttgtagctccctttttcatttcgcgaaagcgaaatgaaaaacgttgttacaataagagatgaatttctcgcaaagctctgcctcttgaaatttcggtttcaagaggcatcttgcactggtttccgcctccgacctgtggctggcctgctttc

SEQ ID NO: 29806 - DNA, 139 bp, synthetic construct
  source 1..139: mol_type = other DNA
cgagaggaaagcaggccagccgttttagtactctggaaacagaatctactaaaacaaggcaaaatgccgtgtttatctcgtcaacttgttggcgagattgcactggtttccgcctccgacctgtggctggcctgctttc

SEQ ID NO: 29807 - DNA, 139 bp, synthetic construct; identical to SEQ ID NO: 29806
  source 1..139: mol_type = other DNA

SEQ ID NO: 29808 - DNA, 139 bp, synthetic construct; identical to SEQ ID NO: 29806
  source 1..139: mol_type = other DNA

SEQ ID NO: 29809 - DNA, 138 bp, synthetic construct
  source 1..138: mol_type = other DNA
gagaggaaagcaggccagccgttttagagctagaaatagcaagttaaaataaggctagtccgttatcaacttgaaaaagtggcaccgagtcggtgcttgcactggtttccgcctccgacctgtggctggcctgctttc

SEQ ID NO: 29810 - DNA, 138 bp, synthetic construct
  source 1..138: mol_type = other DNA
cccagcttgcactggtttccgttttagagctagaaatagcaagttaaaataaggctagtccgttatcaacttgaaaaagtggcaccgagtcggtgcaaagcaggccagccacaggtcggaggcggaaaccagtgcaag

SEQ ID NO: 29811 - DNA, 212 bp, synthetic construct
  source 1..212: mol_type = other DNA
catcccagcttgcactggtttccgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctaaagcaggccagccacaggtcggaggcggaaaccagtgcaag

SEQ ID NO: 29812 - DNA, 212 bp, synthetic construct; identical to SEQ ID NO: 29811
  source 1..212: mol_type = other DNA

SEQ ID NO: 29813 - DNA, 212 bp, synthetic construct; identical to SEQ ID NO: 29811
  source 1..212: mol_type = other DNA

SEQ ID NO: 29814 - DNA, 139 bp, synthetic construct
  source 1..139: mol_type = other DNA
ccgagaggaaagcaggccagcgttttagtactctggaaacagaatctactaaaacaaggcaaaatgccgtgtttatctcgtcaacttgttggcgagatgcactggtttccgcctccgacctgtggctggcctgctttcc

SEQ ID NO: 29815 - DNA, 138 bp, synthetic construct
  source 1..138: mol_type = other DNA
tcccagcttgcactggtttcgttttagagctagaaatagcaagttaaaataaggctagtccgttatcaacttgaaaaagtggcaccgagtcggtgcaagcaggccagccacaggtcggaggcggaaaccagtgcaagc

SEQ ID NO: 29816 - DNA, 138 bp, synthetic construct
  source 1..138: mol_type = other DNA
cgagaggaaagcaggccagcgttttagagctagaaatagcaagttaaaataaggctagtccgttatcaacttgaaaaagtggcaccgagtcggtgctgcactggtttccgcctccgacctgtggctggcctgctttcc

SEQ ID NO: 29817 - DNA, 138 bp, synthetic construct; identical to SEQ ID NO: 29815
  source 1..138: mol_type = other DNA

SEQ ID NO: 29818 - DNA, 138 bp, synthetic construct
  source 1..138: mol_type = other DNA
atcccagcttgcactggtttgttttagagctagaaatagcaagttaaaataaggctagtccgttatcaacttgaaaaagtggcaccgagtcggtgcagcaggccagccacaggtcggaggcggaaaccagtgcaagct

SEQ ID NO: 29819 - DNA, 138 bp, synthetic construct; identical to SEQ ID NO: 29818
  source 1..138: mol_type = other DNA

SEQ ID NO: 29820 - DNA, 138 bp, synthetic construct
  source 1..138: mol_type = other DNA
ccgagaggaaagcaggccaggttttagagctagaaatagcaagttaaaataaggctagtccgttatcaacttgaaaaagtggcaccgagtcggtgcgcactggtttccgcctccgacctgtggctggcctgctttcct

SEQ ID NO: 29821 - DNA, 212 bp, synthetic construct
  source 1..212: mol_type = other DNA
ttcatcccagcttgcactggtttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctagcaggccagccacaggtcggaggcggaaaccagtgcaagct

SEQ ID NO: 29822 - DNA, 187 bp, synthetic construct
  source 1..187: mol_type = other DNA
ttttcatcccagcttgcactggttgttgtagctccctttctcatttcggaaacgaaatgagaaccgttgctacaataaggccgtctgaaaagatgtgccgcaacgctctgccccttaaagcttctgctttaaggggcatcgtttagcaggccagccacaggtcggaggcggaaaccagtgcaagctg

SEQ ID NO: 29823 - DNA, 138 bp, synthetic construct
  source 1..138: mol_type = other DNA
cccgagaggaaagcaggccagttttagagctagaaatagcaagttaaaataaggctagtccgttatcaacttgaaaaagtggcaccgagtcggtgccactggtttccgcctccgacctgtggctggcctgctttcctc

SEQ ID NO: 29824 - DNA, 138 bp, synthetic construct
  source 1..138: mol_type = other DNA
catcccagcttgcactggttgttttagagctagaaatagcaagttaaaataaggctagtccgttatcaacttgaaaaagtggcaccgagtcggtgcgcaggccagccacaggtcggaggcggaaaccagtgcaagctg

SEQ ID NO: 29825 - DNA, 212 bp, synthetic construct
  source 1..212: mol_type = other DNA
aatcccgagaggaaagcaggccagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcactggtttccgcctccgacctgtggctggcctgctttcctc

SEQ ID NO: 29826 - DNA, 212 bp, synthetic construct; identical to SEQ ID NO: 29825
  source 1..212: mol_type = other DNA

SEQ ID NO: 29827 - DNA, 212 bp, synthetic construct
  source 1..212: mol_type = other DNA
tttcatcccagcttgcactggttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgcaggccagccacaggtcggaggcggaaaccagtgcaagctg

SEQ ID NO: 29828 - DNA, 138 bp, synthetic construct
  source 1..138: mol_type = other DNA
tcccgagaggaaagcaggccgttttagagctagaaatagcaagttaaaataaggctagtccgttatcaacttgaaaaagtggcaccgagtcggtgcactggtttccgcctccgacctgtggctggcctgctttcctct

SEQ ID NO: 29829 - DNA, 138 bp, synthetic construct; identical to SEQ ID NO: 29828
  source 1..138: mol_type = other DNA

SEQ ID NO: 29830 - DNA, 138 bp, synthetic construct
  source 1..138: mol_type = other DNA
tcatcccagcttgcactggtgttttagagctagaaatagcaagttaaaataaggctagtccgttatcaacttgaaaaagtggcaccgagtcggtgccaggccagccacaggtcggaggcggaaaccagtgcaagctgg

SEQ ID NO: 29831 - DNA, 138 bp, synthetic construct
  source 1..138: mol_type = other DNA
atcccgagaggaaagcaggcgttttagagctagaaatagcaagttaaaataaggctagtccgttatcaacttgaaaaagtggcaccgagtcggtgcctggtttccgcctccgacctgtggctggcctgctttcctctc

SEQ ID NO: 29832 - DNA, 138 bp, synthetic construct; identical to SEQ ID NO: 29831
  source 1..138: mol_type = other DNA

SEQ ID NO: 29833 - DNA, 138 bp, synthetic construct
  source 1..138: mol_type = other DNA
ttcatcccagcttgcactgggttttagagctagaaatagcaagttaaaataaggctagtccgttatcaacttgaaaaagtggcaccgagtcggtgcaggccagccacaggtcggaggcggaaaccagtgcaagctggg

SEQ ID NO: 29834 - DNA, 212 bp, synthetic construct
  source 1..212: mol_type = other DNA
gaaatcccgagaggaaagcaggcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctctggtttccgcctccgacctgtggctggcctgctttcctctc

SEQ ID NO: 29835 - DNA, 212 bp, synthetic construct
  source 1..212: mol_type = other DNA
cttttcatcccagcttgcactgggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctaggccagccacaggtcggaggcggaaaccagtgcaagctggg

SEQ ID NO: 29836 - DNA, 187 bp, synthetic construct
  source 1..187: mol_type = other DNA
aagaaatcccgagaggaaagcagggttgtagctccctttctcatttcggaaacgaaatgagaaccgttgctacaataaggccgtctgaaaagatgtgccgcaacgctctgccccttaaagcttctgctttaaggggcatcgtttatggtttccgcctccgacctgtggctggcctgctttcctctcg

SEQ ID NO: 29837 - DNA, 187 bp, synthetic construct
  source 1..187: mol_type = other DNA
ttcttttcatcccagcttgcactggttgtagctccctttctcatttcggaaacgaaatgagaaccgttgctacaataaggccgtctgaaaagatgtgccgcaacgctctgccccttaaagcttctgctttaaggggcatcgtttaggccagccacaggtcggaggcggaaaccagtgcaagctggga

SEQ ID NO: 29838 - DNA, 139 bp, synthetic construct
  source 1..139: mol_type = other DNA
aaatcccgagaggaaagcagggttttagtactctggaaacagaatctactaaaacaaggcaaaatgccgtgtttatctcgtcaacttgttggcgagatggtttccgcctccgacctgtggctggcctgctttcctctcg

SEQ ID NO: 29839 - DNA, 138 bp, synthetic construct
  source 1..138: mol_type = other DNA
aatcccgagaggaaagcagggttttagagctagaaatagcaagttaaaataaggctagtccgttatcaacttgaaaaagtggcaccgagtcggtgctggtttccgcctccgacctgtggctggcctgctttcctctcg

SEQ ID NO: 29840 - DNA, 138 bp, synthetic construct
  source 1..138: mol_type = other DNA
tttcatcccagcttgcactggttttagagctagaaatagcaagttaaaataaggctagtccgttatcaacttgaaaaagtggcaccgagtcggtgcggccagccacaggtcggaggcggaaaccagtgcaagctggga

SEQ ID NO: 29841 - DNA, 212 bp, synthetic construct
  source 1..212: mol_type = other DNA
agaaatcccgagaggaaagcagggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttggtttccgcctccgacctgtggctggcctgctttcctctcg

SEQ ID NO: 29842 - DNA, 212 bp, synthetic construct
  source 1..212: mol_type = other DNA
tcttttcatcccagcttgcactggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctggccagccacaggtcggaggcggaaaccagtgcaagctggga

SEQ ID NO: 29843 - DNA, 139 bp, synthetic construct
  source 1..139: mol_type = other DNA
gaaatcccgagaggaaagcaggttttagtactctggaaacagaatctactaaaacaaggcaaaatgccgtgtttatctcgtcaacttgttggcgagaggtttccgcctccgacctgtggctggcctgctttcctctcgg

SEQ ID NO: 29844 - DNA, 138 bp, synthetic construct
  source 1..138: mol_type = other DNA
ttttcatcccagcttgcactgttttagagctagaaatagcaagttaaaataaggctagtccgttatcaacttgaaaaagtggcaccgagtcggtgcgccagccacaggtcggaggcggaaaccagtgcaagctgggat

SEQ ID NO: 29845 - DNA, 138 bp, synthetic construct; identical to SEQ ID NO: 29844
  source 1..138: mol_type = other DNA

SEQ ID NO: 29846 - DNA, 138 bp, synthetic construct
  source 1..138: mol_type = other DNA
aaatcccgagaggaaagcaggttttagagctagaaatagcaagttaaaataaggctagtccgttatcaacttgaaaaagtggcaccgagtcggtgcggtttccgcctccgacctgtggctggcctgctttcctctcgg

SEQ ID NO: 29847 - DNA, 138 bp, synthetic construct
  source 1..138: mol_type = other DNA
cttttcatcccagcttgcacgttttagagctagaaatagcaagttaaaataaggctagtccgttatcaacttgaaaaagtggcaccgagtcggtgcccagccacaggtcggaggcggaaaccagtgcaagctgggatg

SEQ ID NO: 29848 - DNA, 138 bp, synthetic construct; identical to SEQ ID NO: 29847
  source 1..138: mol_type = other DNA

SEQ ID NO: 29849 - DNA, 138 bp, synthetic construct; identical to SEQ ID NO: 29847
  source 1..138: mol_type = other DNA

SEQ ID NO: 29850 - DNA, 138 bp, synthetic construct
  source 1..138: mol_type = other DNA
gaaatcccgagaggaaagcagttttagagctagaaatagcaagttaaaataaggctagtccgttatcaacttgaaaaagtggcaccgagtcggtgcgtttccgcctccgacctgtggctggcctgctttcctctcggg

SEQ ID NO: 29851 - DNA, 138 bp, synthetic construct; identical to SEQ ID NO: 29847
  source 1..138: mol_type = other DNA

SEQ ID NO: 29852 - DNA, 138 bp, synthetic construct; identical to SEQ ID NO: 29850
  source 1..138: mol_type = other DNA

SEQ ID NO: 29853 - DNA, 139 bp, synthetic construct
  source 1..139: mol_type = other DNA
ttcttttcatcccagcttgcagttttagtactctggaaacagaatctactaaaacaaggcaaaatgccgtgtttatctcgtcaacttgttggcgagacagccacaggtcggaggcggaaaccagtgcaagctgggatga

SEQ ID NO: 29854 - DNA, 139 bp, synthetic construct; identical to SEQ ID NO: 29853
  source 1..139: mol_type = other DNA

SEQ ID NO: 29855 - DNA, 138 bp, synthetic construct
  source 1..138: mol_type = other DNA
agaaatcccgagaggaaagcgttttagagctagaaatagcaagttaaaataaggctagtccgttatcaacttgaaaaagtggcaccgagtcggtgctttccgcctccgacctgtggctggcctgctttcctctcggga

SEQ ID NO: 29856 - DNA, 138 bp, synthetic construct; identical to SEQ ID NO: 29855
  source 1..138: mol_type = other DNA

SEQ ID NO: 29857 - DNA, 138 bp, synthetic construct; identical to SEQ ID NO: 29855
  source 1..138: mol_type = other DNA

SEQ ID NO: 29858 - DNA, 138 bp, synthetic construct
  source 1..138: mol_type = other DNA
tcttttcatcccagcttgcagttttagagctagaaatagcaagttaaaataaggctagtccgttatcaacttgaaaaagtggcaccgagtcggtgccagccacaggtcggaggcggaaaccagtgcaagctgggatga

SEQ ID NO: 29859 - DNA, 138 bp, synthetic construct; identical to SEQ ID NO: 29858
  source 1..138: mol_type = other DNA

SEQ ID NO: 29860 - DNA, 138 bp, synthetic construct; identical to SEQ ID NO: 29855
  source 1..138: mol_type = other DNA

SEQ ID NO: 29861 - DNA, 212 bp, synthetic construct
  source 1..212: mol_type = other DNA
ccaagaaatcccgagaggaaagcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttttccgcctccgacctgtggctggcctgctttcctctcggga

SEQ ID NO: 29862 - DNA, 187 bp, synthetic construct
  source 1..187: mol_type = other DNA
acccaagaaatcccgagaggaaaggttgtagctccctttctcatttcggaaacgaaatgagaaccgttgctacaataaggccgtctgaaaagatgtgccgcaacgctctgccccttaaagcttctgctttaaggggcatcgtttattccgcctccgacctgtggctggcctgctttcctctcgggat

SEQ ID NO: 29863 - DNA, 177 bp, synthetic construct
  source 1..177: mol_type = other DNA
tttcttcttttcatcccagcttgcgttgtagctccctttttcatttcgcgaaagcgaaatgaaaaacgttgttacaataagagatgaatttctcgcaaagctctgcctcttgaaatttcggtttcaagaggcatcagccacaggtcggaggcggaaaccagtgcaagctgggatgaa

SEQ ID NO: 29864 - DNA, 139 bp, synthetic construct
  source 1..139: mol_type = other DNA
cttcttttcatcccagcttgcgttttagtactctggaaacagaatctactaaaacaaggcaaaatgccgtgtttatctcgtcaacttgttggcgagaagccacaggtcggaggcggaaaccagtgcaagctgggatgaa

SEQ ID NO: 29865 - DNA, 139 bp, synthetic construct; identical to SEQ ID NO: 29864
  source 1..139: mol_type = other DNA

SEQ ID NO: 29866 - DNA, 139 bp, synthetic construct
  source 1..139: mol_type = other DNA
caagaaatcccgagaggaaaggttttagtactctggaaacagaatctactaaaacaaggcaaaatgccgtgtttatctcgtcaacttgttggcgagattccgcctccgacctgtggctggcctgctttcctctcgggat

SEQ ID NO: 29867 - DNA, 139 bp, synthetic construct; identical to SEQ ID NO: 29866
  source 1..139: mol_type = other DNA

SEQ ID NO: 29868 - DNA, 138 bp, synthetic construct
  source 1..138: mol_type = other DNA
aagaaatcccgagaggaaaggttttagagctagaaatagcaagttaaaataaggctagtccgttatcaacttgaaaaagtggcaccgagtcggtgcttccgcctccgacctgtggctggcctgctttcctctcgggat

SEQ ID NO: 29869 - DNA, 138 bp, synthetic construct; identical to SEQ ID NO: 29868
  source 1..138: mol_type = other DNA

SEQ ID NO: 29870 - DNA, 138 bp, synthetic construct
  source 1..138: mol_type = other DNA
ttcttttcatcccagcttgcgttttagagctagaaatagcaagttaaaataaggctagtccgttatcaacttgaaaaagtggcaccgagtcggtgcagccacaggtcggaggcggaaaccagtgcaagctgggatgaa

SEQ ID NO: 29871 - DNA, 212 bp, synthetic construct
  source 1..212: mol_type = other DNA
cccaagaaatcccgagaggaaaggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctttccgcctccgacctgtggctggcctgctttcctctcgggat

SEQ ID NO: 29872 - DNA, 212 bp, synthetic construct; identical to SEQ ID NO: 29871
  source 1..212: mol_type = other DNA

SEQ ID NO: 29873 - DNA, 139 bp, synthetic construct
  source 1..139: mol_type = other DNA
ccaagaaatcccgagaggaaagttttagtactctggaaacagaatctactaaaacaaggcaaaatgccgtgtttatctcgtcaacttgttggcgagatccgcctccgacctgtggctggcctgctttcctctcgggatt

SEQ ID NO: 29874 - DNA, 139 bp, synthetic construct; identical to SEQ ID NO: 29873
  source 1..139: mol_type = other DNA

SEQ ID NO: 29875 - DNA, 138 bp, synthetic construct
  source 1..138: mol_type = other DNA
cttcttttcatcccagcttggttttagagctagaaatagcaagttaaaataaggctagtccgttatcaacttgaaaaagtggcaccgagtcggtgcgccacaggtcggaggcggaaaccagtgcaagctgggatgaaa

SEQ ID NO: 29876 - DNA, 138 bp, synthetic construct
  source 1..138: mol_type = other DNA
caagaaatcccgagaggaaagttttagagctagaaatagcaagttaaaataaggctagtccgttatcaacttgaaaaagtggcaccgagtcggtgctccgcctccgacctgtggctggcctgctttcctctcgggatt

SEQ ID NO: 29877 - DNA, 139 bp, synthetic construct
  source 1..139: mol_type = other DNA
cccaagaaatcccgagaggaagttttagtactctggaaacagaatctactaaaacaaggcaaaatgccgtgtttatctcgtcaacttgttggcgagaccgcctccgacctgtggctggcctgctttcctctcgggattt

SEQ ID NO: 29878 - DNA, 138 bp, synthetic construct
  source 1..138: mol_type = other DNA
ccaagaaatcccgagaggaagttttagagctagaaatagcaagttaaaataaggctagtccgttatcaacttgaaaaagtggcaccgagtcggtgcccgcctccgacctgtggctggcctgctttcctctcgggattt

SEQ ID NO: 29879 - DNA, 138 bp, synthetic construct; identical to SEQ ID NO: 29878
  source 1..138: mol_type = other DNA

SEQ ID NO: 29880 - DNA, 138 bp, synthetic construct
  source 1..138: mol_type = other DNA
tcttcttttcatcccagcttgttttagagctagaaatagcaagttaaaataaggctagtccgttatcaacttgaaaaagtggcaccgagtcggtgcccacaggtcggaggcggaaaccagtgcaagctgggatgaaaa

SEQ ID NO: 29881 - DNA, 138 bp, synthetic construct
  source 1..138: mol_type = other DNA
cccaagaaatcccgagaggagttttagagctagaaatagcaagttaaaataaggctagtccgttatcaacttgaaaaagtggcaccgagtcggtgccgcctccgacctgtggctggcctgctttcctctcgggatttc

SEQ ID NO: 29882 - DNA, 138 bp, synthetic construct; identical to SEQ ID NO: 29881
  source 1..138: mol_type = other DNA

SEQ ID NO: 29883 - DNA, 138 bp, synthetic construct
  source 1..138: mol_type = other DNA
ttcttcttttcatcccagctgttttagagctagaaatagcaagttaaaataaggctagtccgttatcaacttgaaaaagtggcaccgagtcggtgccacaggtcggaggcggaaaccagtgcaagctgggatgaaaag

SEQ ID NO: 29884 - DNA, 138 bp, synthetic construct; identical to SEQ ID NO: 29883
  source 1..138: mol_type = other DNA

SEQ ID NO: 29885 - DNA, 212 bp, synthetic construct
  source 1..212: mol_type = other DNA
tctttcttcttttcatcccagctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcacaggtcggaggcggaaaccagtgcaagctgggatgaaaag

SEQ ID NO: 29886 - DNA, 212 bp, synthetic construct; identical to SEQ ID NO: 29885
  source 1..212: mol_type = other DNA

SEQ ID NO: 29887 - DNA, 139 bp, synthetic construct
  source 1..139: mol_type = other DNA
cacccaagaaatcccgagagggttttagtactctggaaacagaatctactaaaacaaggcaaaatgccgtgtttatctcgtcaacttgttggcgagagcctccgacctgtggctggcctgctttcctctcgggatttct

SEQ ID NO: 29888 - DNA, 138 bp, synthetic construct
  source 1..138: mol_type = other DNA
tttcttcttttcatcccagcgttttagagctagaaatagcaagttaaaataaggctagtccgttatcaacttgaaaaagtggcaccgagtcggtgcacaggtcggaggcggaaaccagtgcaagctgggatgaaaaga

SEQ ID NO: 29889 - DNA, 138 bp, synthetic construct; identical to SEQ ID NO: 29888
  source 1..138: mol_type = other DNA

SEQ ID NO: 29890 - DNA, 138 bp, synthetic construct
  source 1..138: mol_type = other DNA
acccaagaaatcccgagagggttttagagctagaaatagcaagttaaaataaggctagtccgttatcaacttgaaaaagtggcaccgagtcggtgcgcctccgacctgtggctggcctgctttcctctcgggatttct

SEQ ID NO: 29891 - DNA, 212 bp, synthetic construct
  source 1..212: mol_type = other DNA
gccacccaagaaatcccgagagggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgcctccgacctgtggctggcctgctttcctctcgggatttct

SEQ ID NO: 29892 - DNA, 212 bp, synthetic construct; identical to SEQ ID NO: 29891
  source 1..212: mol_type = other DNA

SEQ ID NO: 29893 - DNA, 139 bp, synthetic construct
  source 1..139: mol_type = other DNA
ccacccaagaaatcccgagaggttttagtactctggaaacagaatctactaaaacaaggcaaaatgccgtgtttatctcgtcaacttgttggcgagacctccgacctgtggctggcctgctttcctctcgggatttctt

SEQ ID NO: 29894 - DNA, 138 bp, synthetic construct
  source 1..138: mol_type = other DNA
cacccaagaaatcccgagaggttttagagctagaaatagcaagttaaaataaggctagtccgttatcaacttgaaaaagtggcaccgagtcggtgccctccgacctgtggctggcctgctttcctctcgggatttctt

SEQ ID NO: 29895 - DNA, 138 bp, synthetic construct
  source 1..138: mol_type = other DNA
ctttcttcttttcatcccaggttttagagctagaaatagcaagttaaaataaggctagtccgttatcaacttgaaaaagtggcaccgagtcggtgccaggtcggaggcggaaaccagtgcaagctgggatgaaaagaa

SEQ ID NO: 29896 - DNA, 212 bp, synthetic construct
  source 1..212: mol_type = other DNA
tttctttcttcttttcatcccaggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcaggtcggaggcggaaaccagtgcaagctgggatgaaaagaa

SEQ ID NO: 29897 - DNA, 139 bp, synthetic construct
  source 1..139: mol_type = other DNA
gccacccaagaaatcccgagagttttagtactctggaaacagaatctactaaaacaaggcaaaatgccgtgtttatctcgtcaacttgttggcgagactccgacctgtggctggcctgctttcctctcgggatttcttg

SEQ ID NO: 29898 - DNA, 138 bp, synthetic construct
  source 1..138: mol_type = other DNA
ccacccaagaaatcccgagagttttagagctagaaatagcaagttaaaataaggctagtccgttatcaacttgaaaaagtggcaccgagtcggtgcctccgacctgtggctggcctgctttcctctcgggatttcttg

SEQ ID NO: 29899 - DNA, 138 bp, synthetic construct; identical to SEQ ID NO: 29898
  source 1..138: mol_type = other DNA

SEQ ID NO: 29900 - DNA, 138 bp, synthetic construct
  source 1..138: mol_type = other DNA
tctttcttcttttcatcccagttttagagctagaaatagcaagttaaaataaggctagtccgttatcaacttgaaaaagtggcaccgagtcggtgcaggtcggaggcggaaaccagtgcaagctgggatgaaaagaag

SEQ ID NO: 29901 - DNA, 141 bp, synthetic construct
  source 1..141: mol_type = other DNA
caggccacccaagaaatcccgaggttttagtactctggaaacagaatctactaaaacaaggcaaaatgccgtgtttatctcgtcaacttgttggcgagatccgacctgtggctggcctgctttcctctcgggatttcttgg

SEQ ID NO: 29902 - DNA, 139 bp, synthetic construct
  source 1..139: mol_type = other DNA
ggccacccaagaaatcccgaggttttagtactctggaaacagaatctactaaaacaaggcaaaatgccgtgtttatctcgtcaacttgttggcgagatccgacctgtggctggcctgctttcctctcgggatttcttgg

SEQ ID NO: 29903 - DNA, 138 bp, synthetic construct
  source 1..138: mol_type = other DNA
gccacccaagaaatcccgaggttttagagctagaaatagcaagttaaaataaggctagtccgttatcaacttgaaaaagtggcaccgagtcggtgctccgacctgtggctggcctgctttcctctcgggatttcttgg

SEQ ID NO: 29904 - DNA, 138 bp, synthetic construct; identical to SEQ ID NO: 29903
  source 1..138: mol_type = other DNA

SEQ ID NO: 29905 - DNA, 138 bp, synthetic construct; identical to SEQ ID NO: 29903
  source 1..138: mol_type = other DNA

SEQ ID NO: 29906 - DNA, 138 bp, synthetic construct; identical to SEQ ID NO: 29903
  source 1..138: mol_type = other DNA

SEQ ID NO: 29907 - DNA, 138 bp, synthetic construct
  source 1..138: mol_type = other DNA
ttctttcttcttttcatcccgttttagagctagaaatagcaagttaaaataaggctagtccgttatcaacttgaaaaagtggcaccgagtcggtgcggtcggaggcggaaaccagtgcaagctgggatgaaaagaaga

SEQ ID NO: 29908 - DNA, 138 bp, synthetic construct; identical to SEQ ID NO: 29907
  source 1..138: mol_type = other DNA

SEQ ID NO: 29909 - DNA, 141 bp, synthetic construct
  source 1..141: mol_type = other DNA
ccaggccacccaagaaatcccgagttttagtactctggaaacagaatctactaaaacaaggcaaaatgccgtgtttatctcgtcaacttgttggcgagaccgacctgtggctggcctgctttcctctcgggatttcttggg

SEQ ID NO: 29910 - DNA, 139 bp, synthetic construct
  source 1..139: mol_type = other DNA
aggccacccaagaaatcccgagttttagtactctggaaacagaatctactaaaacaaggcaaaatgccgtgtttatctcgtcaacttgttggcgagaccgacctgtggctggcctgctttcctctcgggatttcttggg

SEQ ID NO: 29911 - DNA, 139 bp, synthetic construct; identical to SEQ ID NO: 29910
  source 1..139: mol_type = other DNA

SEQ ID NO: 29912 - DNA, 139 bp, synthetic construct; identical to SEQ ID NO: 29910
  source 1..139: mol_type = other DNA

SEQ ID NO: 29913 - DNA, 138 bp, synthetic construct
  source 1..138: mol_type = other DNA
ggccacccaagaaatcccgagttttagagctagaaatagcaagttaaaataaggctagtccgttatcaacttgaaaaagtggcaccgagtcggtgcccgacctgtggctggcctgctttcctctcgggatttcttggg

SEQ ID NO: 29914 - DNA, 138 bp, synthetic construct; identical to SEQ ID NO: 29913
  source 1..138: mol_type = other DNA

SEQ ID NO: 29915 - DNA, 138 bp, synthetic construct
  source 1..138: mol_type = other DNA
tttctttcttcttttcatccgttttagagctagaaatagcaagttaaaataaggctagtccgttatcaacttgaaaaagtggcaccgagtcggtgcgtcggaggcggaaaccagtgcaagctgggatgaaaagaagaa

SEQ ID NO: 29916 - DNA, 138 bp, synthetic construct; identical to SEQ ID NO: 29915
  source 1..138: mol_type = other DNA

SEQ ID NO: 29917 - DNA, 146 bp, synthetic construct
  source 1..146: mol_type = other DNA
ggccacccaagaaatcccgagtctttgtactctggtaccagaagctacaaagataaggcttcatgccgaaatcaacaccctgtcattttatggcagggtgttttccgacctgtggctggcctgctttcctctcgggatttcttggg

SEQ ID NO: 29918 - DNA, 139 bp, synthetic construct
  source 1..139: mol_type = other DNA
caggccacccaagaaatcccggttttagtactctggaaacagaatctactaaaacaaggcaaaatgccgtgtttatctcgtcaacttgttggcgagacgacctgtggctggcctgctttcctctcgggatttcttgggt

SEQ ID NO: 29919 - DNA, 139 bp, synthetic construct; identical to SEQ ID NO: 29918
  source 1..139: mol_type = other DNA

SEQ ID NO: 29920 - DNA, 139 bp, synthetic construct
  source 1..139: mol_type = other DNA
gttttctttcttcttttcatcgttttagtactctggaaacagaatctactaaaacaaggcaaaatgccgtgtttatctcgtcaacttgttggcgagatcggaggcggaaaccagtgcaagctgggatgaaaagaagaaa

SEQ ID NO: 29921 - DNA, 138 bp, synthetic construct
  source 1..138: mol_type = other DNA
aggccacccaagaaatcccggttttagagctagaaatagcaagttaaaataaggctagtccgttatcaacttgaaaaagtggcaccgagtcggtgccgacctgtggctggcctgctttcctctcgggatttcttgggt

SEQ ID NO: 29922 - DNA, 138 bp, synthetic construct; identical to SEQ ID NO: 29921
  source 1..138: mol_type = other DNA

SEQ ID NO: 29923 - DNA, 138 bp, synthetic construct
  source 1..138: mol_type = other DNA
ttttctttcttcttttcatcgttttagagctagaaatagcaagttaaaataaggctagtccgttatcaacttgaaaaagtggcaccgagtcggtgctcggaggcggaaaccagtgcaagctgggatgaaaagaagaaa

SEQ ID NO: 29924 - DNA, 146 bp, synthetic construct
  source 1..146: mol_type = other DNA
aggccacccaagaaatcccggtctttgtactctggtaccagaagctacaaagataaggcttcatgccgaaatcaacaccctgtcattttatggcagggtgttttcgacctgtggctggcctgctttcctctcgggatttcttgggt

SEQ ID NO: 29925 - DNA, 212 bp, synthetic construct
  source 1..212: mol_type = other DNA
gagttttctttcttcttttcatcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttcggaggcggaaaccagtgcaagctgggatgaaaagaagaaa

SEQ ID NO: 29926 - DNA, 212 bp, synthetic construct; identical to SEQ ID NO: 29925
  source 1..212: mol_type = other DNA

SEQ ID NO: 29927 - DNA, 141 bp, synthetic construct
  source 1..141: mol_type = other DNA
ggccaggccacccaagaaatcccgttttagtactctggaaacagaatctactaaaacaaggcaaaatgccgtgtttatctcgtcaacttgttggcgagagacctgtggctggcctgctttcctctcgggatttcttgggtg

SEQ ID NO: 29928 - DNA, 139 bp, synthetic construct
  source 1..139: mol_type = other DNA
ccaggccacccaagaaatcccgttttagtactctggaaacagaatctactaaaacaaggcaaaatgccgtgtttatctcgtcaacttgttggcgagagacctgtggctggcctgctttcctctcgggatttcttgggtg

SEQ ID NO: 29929 - DNA, 139 bp, synthetic construct
  source 1..139: mol_type = other DNA
agttttctttcttcttttcatgttttagtactctggaaacagaatctactaaaacaaggcaaaatgccgtgtttatctcgtcaacttgttggcgagacggaggcggaaaccagtgcaagctgggatgaaaagaagaaag

SEQ ID NO: 29930 - DNA, 138 bp, synthetic construct
  source 1..138: mol_type = other DNA
caggccacccaagaaatcccgttttagagctagaaatagcaagttaaaataaggctagtccgttatcaacttgaaaaagtggcaccgagtcggtgcgacctgtggctggcctgctttcctctcgggatttcttgggtg

SEQ ID NO: 29931 - DNA, 138 bp, synthetic construct; identical to SEQ ID NO: 29930
  source 1..138: mol_type = other DNA

SEQ ID NO: 29932 - DNA, 138 bp, synthetic construct
  source 1..138: mol_type = other DNA
gttttctttcttcttttcatgttttagagctagaaatagcaagttaaaataaggctagtccgttatcaacttgaaaaagtggcaccgagtcggtgccggaggcggaaaccagtgcaagctgggatgaaaagaagaaag

SEQ ID NO: 29933 - DNA, 139 bp, synthetic construct
  source 1..139: mol_type = other DNA
gccaggccacccaagaaatccgttttagtactctggaaacagaatctactaaaacaaggcaaaatgccgtgtttatctcgtcaacttgttggcgagaacctgtggctggcctgctttcctctcgggatttcttgggtgg

SEQ ID NO: 29934 - DNA, 139 bp, synthetic construct; identical to SEQ ID NO: 29933
  source 1..139: mol_type = other DNA

SEQ ID NO: 29935 - DNA, 138 bp, synthetic construct
  source 1..138: mol_type = other DNA
ccaggccacccaagaaatccgttttagagctagaaatagcaagttaaaataaggctagtccgttatcaacttgaaaaagtggcaccgagtcggtgcacctgtggctggcctgctttcctctcgggatttcttgggtgg

SEQ ID NO: 29936 - DNA, 138 bp, synthetic construct; identical to SEQ ID NO: 29935
  source 1..138: mol_type = other DNA

SEQ ID NO: 29937 - DNA, 138 bp, synthetic construct
  source 1..138: mol_type = other DNA
agttttctttcttcttttcagttttagagctagaaatagcaagttaaaataaggctagtccgttatcaacttgaaaaagtggcaccgagtcggtgcggaggcggaaaccagtgcaagctgggatgaaaagaagaaaga

SEQ ID NO: 29938 - DNA, 96 bp, synthetic construct
  source 1..96: mol_type = other DNA
cacggttcgggggtatacatgttttagagctagaaatagcaagttaaaataaggctagtccgttatcaacttgaaaaagtggcaccgagtcggtgc

SEQ ID NO: 29939 - DNA, 96 bp, synthetic construct
  source 1..96: mol_type = other DNA
acggttcgggggtatacatggttttagagctagaaatagcaagttaaaataaggctagtccgttatcaacttgaaaaagtggcaccgagtcggtgc

SEQ ID NO: 29940 - DNA, 97 bp, synthetic construct
  source 1..97: mol_type = other DNA
tgtgtactactccactacctagttttagtactctggaaacagaatctactaaaacaaggcaaaatgccgtgtttatctcgtcaacttgttggcgaga

SEQ ID NO: 29941 - DNA, 97 bp, synthetic construct
  source 1..97: mol_type = other DNA
atgtgtactactccactacctgttttagtactctggaaacagaatctactaaaacaaggcaaaatgccgtgtttatctcgtcaacttgttggcgaga

SEQ ID NO: 29942 - DNA, 96 bp, synthetic construct
  source 1..96: mol_type = other DNA
gtgtactactccactacctagttttagagctagaaatagcaagttaaaataaggctagtccgttatcaacttgaaaaagtggcaccgagtcggtgc

SEQ ID NO: 29943 - DNA, 96 bp, synthetic construct
  source 1..96: mol_type = other DNA
cagttatgtgtactactccagttttagagctagaaatagcaagttaaaataaggctagtccgttatcaacttgaaaaagtggcaccgagtcggtgc

SEQ ID NO: 29944 - DNA, 96 bp, synthetic construct
  source 1..96: mol_type = other DNA
cggttcgggggtatacatgggttttagagctagaaatagcaagttaaaataaggctagtccgttatcaacttgaaaaagtggcaccgagtcggtgc

SEQ ID NO: 29945 - DNA, 170 bp, synthetic construct
  source 1..170: mol_type = other DNA
gggcagttatgtgtactactccagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29946 - DNA, 170 bp, synthetic construct; identical to SEQ ID NO: 29945
  source 1..170: mol_type = other DNA

SEQ ID NO: 29947 - DNA, 97 bp, synthetic construct
  source 1..97: mol_type = other DNA
gttatgtgtactactccactagttttagtactctggaaacagaatctactaaaacaaggcaaaatgccgtgtttatctcgtcaacttgttggcgaga

SEQ ID NO: 29948 - DNA, 97 bp, synthetic construct; identical to SEQ ID NO: 29941
  source 1..97: mol_type = other DNA

SEQ ID NO: 29949 - DNA, 96 bp, synthetic construct
  source 1..96: mol_type = other DNA
tgtactactccactacctaagttttagagctagaaatagcaagttaaaataaggctagtccgttatcaacttgaaaaagtggcaccgagtcggtgc

SEQ ID NO: 29950 - DNA, 96 bp, synthetic construct
  source 1..96: mol_type = other DNA
agttatgtgtactactccacgttttagagctagaaatagcaagttaaaataaggctagtccgttatcaacttgaaaaagtggcaccgagtcggtgc

SEQ ID NO: 29951 - DNA, 96 bp, synthetic construct
  source 1..96: mol_type = other DNA
ggttcgggggtatacatggggttttagagctagaaatagcaagttaaaataaggctagtccgttatcaacttgaaaaagtggcaccgagtcggtgc

SEQ ID NO: 29952 - DNA, 99 bp, synthetic construct
  source 1..99: mol_type = other DNA
gcctagcgtcaaagcctatgtccgttttagtactctggaaacagaatctactaaaacaaggcaaaatgccgtgtttatctcgtcaacttgttggcgaga

SEQ ID NO: 29953 - DNA, 97 bp, synthetic construct; identical to SEQ ID NO: 29947
  source 1..97: mol_type = other DNA

SEQ ID NO: 29954 - DNA, 96 bp, synthetic construct; identical to SEQ ID NO: 29942
  source 1..96: mol_type = other DNA

SEQ ID NO: 29955 - DNA, 96 bp, synthetic construct; identical to SEQ ID NO: 29949
  source 1..96: mol_type = other DNA

SEQ ID NO: 29956 - DNA, 96 bp, synthetic construct
  source 1..96: mol_type = other DNA
gttatgtgtactactccactgttttagagctagaaatagcaagttaaaataaggctagtccgttatcaacttgaaaaagtggcaccgagtcggtgc

SEQ ID NO: 29957 - DNA, 96 bp, synthetic construct; identical to SEQ ID NO: 29949
  source 1..96: mol_type = other DNA

SEQ ID NO: 29958 - DNA, 96 bp, synthetic construct
  source 1..96: mol_type = other DNA
gttcgggggtatacatgggcgttttagagctagaaatagcaagttaaaataaggctagtccgttatcaacttgaaaaagtggcaccgagtcggtgc

SEQ ID NO: 29959 - DNA, 99 bp, synthetic construct; identical to SEQ ID NO: 29952
  source 1..99: mol_type = other DNA

SEQ ID NO: 29960 - DNA, 97 bp, synthetic construct; identical to SEQ ID NO: 29947
  source 1..97: mol_type = other DNA

SEQ ID NO: 29961 - DNA, 97 bp, synthetic construct; identical to SEQ ID NO: 29940
  source 1..97: mol_type = other DNA

SEQ ID NO: 29962 - DNA, 97 bp, synthetic construct; identical to SEQ ID NO: 29941
  source 1..97: mol_type = other DNA

SEQ ID NO: 29963 - DNA, 96 bp, synthetic construct; identical to SEQ ID NO: 29942
  source 1..96: mol_type = other DNA

SEQ ID NO: 29964 - DNA, 96 bp, synthetic construct
  source 1..96: mol_type = other DNA
ttatgtgtactactccactagttttagagctagaaatagcaagttaaaataaggctagtccgttatcaacttgaaaaagtggcaccgagtcggtgc

SEQ ID NO: 29965 - DNA, 96 bp, synthetic construct
  source 1..96: mol_type = other DNA
ttcgggggtatacatgggctgttttagagctagaaatagcaagttaaaataaggctagtccgttatcaacttgaaaaagtggcaccgagtcggtgc

SEQ ID NO: 29966 - DNA, 170 bp, synthetic construct
  source 1..170: mol_type = other DNA
ggttcgggggtatacatgggcttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29967 - DNA, 170 bp, synthetic construct; identical to SEQ ID NO: 29966
  source 1..170: mol_type = other DNA

SEQ ID NO: 29968 - DNA, 145 bp, synthetic construct
  source 1..145: mol_type = other DNA
cggttcgggggtatacatgggcttgttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 29969 - DNA, 97 bp, synthetic construct
  source 1..97: mol_type = other DNA
ttatgtgtactactccactacgttttagtactctggaaacagaatctactaaaacaaggcaaaatgccgtgtttatctcgtcaacttgttggcgaga

SEQ ID NO: 29970 - DNA, 96 bp, synthetic construct
  source 1..96: mol_type = other DNA
tatgtgtactactccactacgttttagagctagaaatagcaagttaaaataaggctagtccgttatcaacttgaaaaagtggcaccgagtcggtgc

SEQ ID NO: 29971 - DNA, 96 bp, synthetic construct
  source 1..96: mol_type = other DNA
tcgggggtatacatgggcttgttttagagctagaaatagcaagttaaaataaggctagtccgttatcaacttgaaaaagtggcaccgagtcggtgc

SEQ ID NO: 29972 - DNA, 170 bp, synthetic construct; identical to SEQ ID NO: 29966
  source 1..170: mol_type = other DNA

SEQ ID NO: 29973 - DNA, 170 bp, synthetic construct; identical to SEQ ID NO: 29966
  source 1..170: mol_type = other DNA

SEQ ID NO: 29974 - DNA, 97 bp, synthetic construct
  source 1..97: mol_type = other DNA
ggttcgggggtatacatgggcgttttagtactctggaaacagaatctactaaaacaaggcaaaatgccgtgtttatctcgtcaacttgttggcgaga

SEQ ID NO: 29975 - DNA, 96 bp, synthetic construct; identical to SEQ ID NO: 29949
  source 1..96: mol_type = other DNA

SEQ ID NO: 29976 - DNA, 96 bp, synthetic construct
  source 1..96: mol_type = other DNA
atgtgtactactccactaccgttttagagctagaaatagcaagttaaaataaggctagtccgttatcaacttgaaaaagtggcaccgagtcggtgc

SEQ ID NO: 29977 - DNA, 96 bp, synthetic construct
  source 1..96: mol_type = other DNA
cgggggtatacatgggcttggttttagagctagaaatagcaagttaaaataaggctagtccgttatcaacttgaaaaagtggcaccgagtcggtgc

SEQ ID NO: 29978 - DNA, 96 bp, synthetic construct; identical to SEQ ID NO: 29942
  source 1..96: mol_type = other DNA

SEQ ID NO: 29979 - DNA, 96 bp, synthetic construct; identical to SEQ ID NO: 29949
  source 1..96: mol_type = other DNA

SEQ ID NO: 29980 - DNA, 96 bp, synthetic construct
  source 1..96: mol_type = other DNA
tgtgtactactccactacctgttttagagctagaaatagcaagttaaaataaggctagtccgttatcaacttgaaaaagtggcaccgagtcggtgc

SEQ ID NO: 29981 - DNA, 96 bp, synthetic construct; identical to SEQ ID NO: 29949
  source 1..96: mol_type = other DNA

SEQ ID NO: 29982 - DNA, 96 bp, synthetic construct
  source 1..96: mol_type = other DNA
gggggtatacatgggcttgggttttagagctagaaatagcaagttaaaataaggctagtccgttatcaacttgaaaaagtggcaccgagtcggtgc

SEQ ID NO: 29983 - DNA, 97 bp, synthetic construct; identical to SEQ ID NO: 29940
  source 1..97: mol_type = other DNA

SEQ ID NO: 29984 - DNA, 97 bp, synthetic construct; identical to SEQ ID NO: 29940
  source 1..97: mol_type = other DNA

SEQ ID NO: 29985 - DNA, 96 bp, synthetic construct; identical to SEQ ID NO: 29942
  source 1..96: mol_type = other DNA

SEQ ID NO: 29986 - DNA, 96 bp, synthetic construct; identical to SEQ ID NO: 29942
  source 1..96: mol_type = other DNA

SEQ ID NO: 29987 - DNA, 96 bp, synthetic construct
  source 1..96: mol_type = other DNA
ggggtatacatgggcttggagttttagagctagaaatagcaagttaaaataaggctagtccgttatcaacttgaaaaagtggcaccgagtcggtgc

SEQ ID NO: 29988 - DNA, 170 bp, synthetic construct
  source 1..170: mol_type = other DNA
gttcgggggtatacatgggcttggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29989 - DNA, 145 bp, synthetic construct; identical to SEQ ID NO: 29968
  source 1..145: mol_type = other DNA

SEQ ID NO: 29990 - DNA, 135 bp, synthetic construct
  source 1..135: mol_type = other DNA
ctagcgtcaaagcctatgtccctggttgtagctccctttttcatttcgcgaaagcgaaatgaaaaacgttgttacaataagagatgaatttctcgcaaagctctgcctcttgaaatttcggtttcaagaggcatc

SEQ ID NO: 29991 - DNA, 97 bp, synthetic construct; identical to SEQ ID NO: 29941
  source 1..97: mol_type = other DNA

SEQ ID NO: 29992 - DNA, 97 bp, synthetic construct; identical to SEQ ID NO: 29941
  source 1..97: mol_type = other DNA

SEQ ID NO: 29993 - DNA, 97 bp, synthetic construct; identical to SEQ ID NO: 29940
  source 1..97: mol_type = other DNA

SEQ ID NO: 29994 - DNA, 96 bp, synthetic construct; identical to SEQ ID NO: 29949
  source 1..96: mol_type = other DNA

SEQ ID NO: 29995 - DNA, 96 bp, synthetic construct
  source 1..96: mol_type = other DNA
gggtatacatgggcttggatgttttagagctagaaatagcaagttaaaataaggctagtccgttatcaacttgaaaaagtggcaccgagtcggtgc

SEQ ID NO: 29996 - DNA, 170 bp, synthetic construct
  source 1..170: mol_type = other DNA
ggggtatacatgggcttggatccgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 29997 - DNA, 170 bp, synthetic construct; identical to SEQ ID NO: 29996
  source 1..170: mol_type = other DNA

SEQ ID NO: 29998 - DNA, 170 bp, synthetic construct; identical to SEQ ID NO: 29996
  source 1..170: mol_type = other DNA

SEQ ID NO: 29999 - DNA, 97 bp, synthetic construct; identical to SEQ ID NO: 29941
  source 1..97: mol_type = other DNA

SEQ ID NO: 30000 - DNA, 96 bp, synthetic construct
  source 1..96: mol_type = other DNA
tatacatgggcttggatccagttttagagctagaaatagcaagttaaaataaggctagtccgttatcaacttgaaaaagtggcaccgagtcggtgc

SEQ ID NO: 30001 - DNA, 96 bp, synthetic construct
  source 1..96: mol_type = other DNA
gtactactccactacctaaagttttagagctagaaatagcaagttaaaataaggctagtccgttatcaacttgaaaaagtggcaccgagtcggtgc

SEQ ID NO: 30002 - DNA, 96 bp, synthetic construct
  source 1..96: mol_type = other DNA
ggtatacatgggcttggatcgttttagagctagaaatagcaagttaaaataaggctagtccgttatcaacttgaaaaagtggcaccgagtcggtgc

SEQ ID NO: 30003 - DNA, 96 bp, synthetic construct
  source 1..96: mol_type = other DNA
gtatacatgggcttggatccgttttagagctagaaatagcaagttaaaataaggctagtccgttatcaacttgaaaaagtggcaccgagtcggtgc

SEQ ID NO: 30004 - DNA, 96 bp, synthetic construct; identical to SEQ ID NO: 30003
  source 1..96: mol_type = other DNA

SEQ ID NO: 30005 - DNA, 96 bp, synthetic construct
  source 1..96: mol_type = other DNA
tactactccactacctaaaggttttagagctagaaatagcaagttaaaataaggctagtccgttatcaacttgaaaaagtggcaccgagtcggtgc

SEQ ID NO: 30006 - DNA, 170 bp, synthetic construct; identical to SEQ ID NO: 29996
  source 1..170: mol_type = other DNA

SEQ ID NO: 30007 - DNA, 145 bp, synthetic construct; identical to SEQ ID NO: 29968
  source 1..145: mol_type = other DNA

SEQ ID NO: 30008 - DNA, 96 bp, synthetic construct
  source 1..96: mol_type = other DNA
actactccactacctaaagggttttagagctagaaatagcaagttaaaataaggctagtccgttatcaacttgaaaaagtggcaccgagtcggtgc

SEQ ID NO: 30009 - DNA, 96 bp, synthetic construct; identical to SEQ ID NO: 30000
  source 1..96: mol_type = other DNA

SEQ ID NO: 30010 - DNA, 170 bp, synthetic construct
  source 1..170: mol_type = other DNA
tgtactactccactacctaaagggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30011 - DNA, 170 bp, synthetic construct; identical to SEQ ID NO: 30010
  source 1..170: mol_type = other DNA

SEQ ID NO: 30012 - DNA, 170 bp, synthetic construct; identical to SEQ ID NO: 29996
  source 1..170: mol_type = other DNA

SEQ ID NO: 30013 - DNA, 96 bp, synthetic construct; identical to SEQ ID NO: 30001
  source 1..96: mol_type = other DNA

SEQ ID NO: 30014 - DNA, 96 bp, synthetic construct
  source 1..96: mol_type = other DNA
ctactccactacctaaaggtgttttagagctagaaatagcaagttaaaataaggctagtccgttatcaacttgaaaaagtggcaccgagtcggtgc

SEQ ID NO: 30015 - DNA, 96 bp, synthetic construct
  source 1..96: mol_type = other DNA
atacatgggcttggatccatgttttagagctagaaatagcaagttaaaataaggctagtccgttatcaacttgaaaaagtggcaccgagtcggtgc

SEQ ID NO: 30016 - DNA, 96 bp, synthetic construct
  source 1..96: mol_type = other DNA
tccactacctaaaggtctccgttttagagctagaaatagcaagttaaaataaggctagtccgttatcaacttgaaaaagtggcaccgagtcggtgc

SEQ ID NO: 30017 - DNA, 96 bp, synthetic construct
  source 1..96: mol_type = other DNA
tactccactacctaaaggtcgttttagagctagaaatagcaagttaaaataaggctagtccgttatcaacttgaaaaagtggcaccgagtcggtgc

SEQ ID NO: 30018 - DNA, 96 bp, synthetic construct
  source 1..96: mol_type = other DNA
tacatgggcttggatccatggttttagagctagaaatagcaagttaaaataaggctagtccgttatcaacttgaaaaagtggcaccgagtcggtgc

SEQ ID NO: 30019 - DNA, 170 bp, synthetic construct; identical to SEQ ID NO: 30010
  source 1..170: mol_type = other DNA

SEQ ID NO: 30020 - DNA, 170 bp, synthetic construct; identical to SEQ ID NO: 29996
  source 1..170: mol_type = other DNA

SEQ ID NO: 30021 - DNA, 145 bp, synthetic construct
  source 1..145: mol_type = other DNA
tactccactacctaaaggtctcctgttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 30022 - DNA, 145 bp, synthetic construct; identical to SEQ ID NO: 29968
  source 1..145: mol_type = other DNA

SEQ ID NO: 30023 - DNA, 97 bp, synthetic construct
  source 1..97: mol_type = other DNA
actccactacctaaaggtctcgttttagtactctggaaacagaatctactaaaacaaggcaaaatgccgtgtttatctcgtcaacttgttggcgaga

SEQ ID NO: 30024 - DNA, 96 bp, synthetic construct
  source 1..96: mol_type = other DNA
actccactacctaaaggtctgttttagagctagaaatagcaagttaaaataaggctagtccgttatcaacttgaaaaagtggcaccgagtcggtgc

SEQ ID NO: 30025 - DNA, 96 bp, synthetic construct
  source 1..96: mol_type = other DNA
acatgggcttggatccatgtgttttagagctagaaatagcaagttaaaataaggctagtccgttatcaacttgaaaaagtggcaccgagtcggtgc

SEQ ID NO: 30026 - DNA, 170 bp, synthetic construct
  source 1..170: mol_type = other DNA
actccactacctaaaggtctcctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30027 - DNA, 170 bp, synthetic construct
  source 1..170: mol_type = other DNA
catgggcttggatccatgtctgagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30028 - DNA, 97 bp, synthetic construct
  source 1..97: mol_type = other DNA
tactccactacctaaaggtctgttttagtactctggaaacagaatctactaaaacaaggcaaaatgccgtgtttatctcgtcaacttgttggcgaga

SEQ ID NO: 30029 - DNA, 96 bp, synthetic construct
  source 1..96: mol_type = other DNA
catgggcttggatccatgtcgttttagagctagaaatagcaagttaaaataaggctagtccgttatcaacttgaaaaagtggcaccgagtcggtgc

SEQ ID NO: 30030 - DNA, 96 bp, synthetic construct; identical to SEQ ID NO: 30029
  source 1..96: mol_type = other DNA

SEQ ID NO: 30031 - DNA, 96 bp, synthetic construct
  source 1..96: mol_type = other DNA
ctccactacctaaaggtctcgttttagagctagaaatagcaagttaaaataaggctagtccgttatcaacttgaaaaagtggcaccgagtcggtgc

SEQ ID NO: 30032 - DNA, 96 bp, synthetic construct
  source 1..96: mol_type = other DNA
tgggcttggatccatgtctggttttagagctagaaatagcaagttaaaataaggctagtccgttatcaacttgaaaaagtggcaccgagtcggtgc

SEQ ID NO: 30033 - DNA, 96 bp, synthetic construct; identical to SEQ ID NO: 29965
  source 1..96: mol_type = other DNA

SEQ ID NO: 30034 - DNA, 96 bp, synthetic construct
  source 1..96: mol_type = other DNA
atgggcttggatccatgtctgttttagagctagaaatagcaagttaaaataaggctagtccgttatcaacttgaaaaagtggcaccgagtcggtgc

SEQ ID NO: 30035 - DNA, 96 bp, synthetic construct
  source 1..96: mol_type = other DNA
ccactacctaaaggtctcctgttttagagctagaaatagcaagttaaaataaggctagtccgttatcaacttgaaaaagtggcaccgagtcggtgc

SEQ ID NO: 30036 - DNA, 96 bp, synthetic construct; identical to SEQ ID NO: 30029
  source 1..96: mol_type = other DNA

SEQ ID NO: 30037 - DNA, 96 bp, synthetic construct; identical to SEQ ID NO: 30016
  source 1..96: mol_type = other DNA

SEQ ID NO: 30038 - DNA, 97 bp, synthetic construct
  source 1..97: mol_type = other DNA
atgtctgatgtactgtgtgcagttttagtactctggaaacagaatctactaaaacaaggcaaaatgccgtgtttatctcgtcaacttgttggcgaga

SEQ ID NO: 30039 - DNA, 97 bp, synthetic construct
  source 1..97: mol_type = other DNA
tccatgtctgatgtactgtgtgttttagtactctggaaacagaatctactaaaacaaggcaaaatgccgtgtttatctcgtcaacttgttggcgaga

SEQ ID NO: 30040 - DNA, 96 bp, synthetic construct
  source 1..96: mol_type = other DNA
cactacctaaaggtctcctagttttagagctagaaatagcaagttaaaataaggctagtccgttatcaacttgaaaaagtggcaccgagtcggtgc

SEQ ID NO: 30041 - DNA, 96 bp, synthetic construct; identical to SEQ ID NO: 29949
  source 1..96: mol_type = other DNA

SEQ ID NO: 30042 - DNA, 96 bp, synthetic construct; identical to SEQ ID NO: 30035
  source 1..96: mol_type = other DNA

SEQ ID NO: 30043 - DNA, 96 bp, synthetic construct; identical to SEQ ID NO: 30032
  source 1..96: mol_type = other DNA

SEQ ID NO: 30044 - DNA, 96 bp, synthetic construct; identical to SEQ ID NO: 30032
  source 1..96: mol_type = other DNA

SEQ ID NO: 30045 - DNA, 96 bp, synthetic construct; identical to SEQ ID NO: 30035
  source 1..96: mol_type = other DNA

SEQ ID NO: 30046 - DNA, 170 bp, synthetic construct; identical to SEQ ID NO: 30026
  source 1..170: mol_type = other DNA

SEQ ID NO: 30047 - DNA, 145 bp, synthetic construct; identical to SEQ ID NO: 30021
  source 1..145: mol_type = other DNA

SEQ ID NO: 30048 - DNA, 135 bp, synthetic construct
  source 1..135: mol_type = other DNA
aactggtagctggaggacagtactgttgtagctccctttttcatttcgcgaaagcgaaatgaaaaacgttgttacaataagagatgaatttctcgcaaagctctgcctcttgaaatttcggtttcaagaggcatc

SEQ ID NO: 30049 - DNA, 97 bp, synthetic construct
  source 1..97: mol_type = other DNA
atacatgggcttggatccatggttttagtactctggaaacagaatctactaaaacaaggcaaaatgccgtgtttatctcgtcaacttgttggcgaga

SEQ ID NO: 30050 - DNA, 97 bp, synthetic construct; identical to SEQ ID NO: 30049
  source 1..97: mol_type = other DNA

SEQ ID NO: 30051 - DNA, 97 bp, synthetic construct; identical to SEQ ID NO: 29940
  source 1..97: mol_type = other DNA

SEQ ID NO: 30052 - DNA, 97 bp, synthetic construct; identical to SEQ ID NO: 30023
  source 1..97: mol_type = other DNA

SEQ ID NO: 30053 - DNA, 96 bp, synthetic construct; identical to SEQ ID NO: 30040
  source 1..96: mol_type = other DNA

SEQ ID NO: 30054 - DNA, 96 bp, synthetic construct; identical to SEQ ID NO: 30040
  source 1..96: mol_type = other DNA

SEQ ID NO: 30055 - DNA, 96 bp, synthetic construct
  source 1..96: mol_type = other DNA
gggcttggatccatgtctgagttttagagctagaaatagcaagttaaaataaggctagtccgttatcaacttgaaaaagtggcaccgagtcggtgc

SEQ ID NO: 30056 - DNA, 170 bp, synthetic construct
  source 1..170: mol_type = other DNA
ctccactacctaaaggtctcctagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30057 - DNA, 170 bp, synthetic construct; identical to SEQ ID NO: 30056
  source 1..170: mol_type = other DNA

SEQ ID NO: 30058 - DNA, 97 bp, synthetic construct
  source 1..97: mol_type = other DNA
acctaaaggtctcctagtgccgttttagtactctggaaacagaatctactaaaacaaggcaaaatgccgtgtttatctcgtcaacttgttggcgaga

SEQ ID NO: 30059 - DNA, 97 bp, synthetic construct; identical to SEQ ID NO: 30023
  source 1..97: mol_type = other DNA

SEQ ID NO: 30060 - DNA, 96 bp, synthetic construct
  source 1..96: mol_type = other DNA
ggcttggatccatgtctgatgttttagagctagaaatagcaagttaaaataaggctagtccgttatcaacttgaaaaagtggcaccgagtcggtgc

SEQ ID NO: 30061 - DNA, 96 bp, synthetic construct
  source 1..96: mol_type = other DNA
actacctaaaggtctcctaggttttagagctagaaatagcaagttaaaataaggctagtccgttatcaacttgaaaaagtggcaccgagtcggtgc

SEQ ID NO: 30062 - DNA, 97 bp, synthetic construct; identical to SEQ ID NO: 30058
  source 1..97: mol_type = other DNA

SEQ ID NO: 30063 - DNA, 96 bp, synthetic construct; identical to SEQ ID NO: 30061
  source 1..96: mol_type = other DNA

SEQ ID NO: 30064 - DNA, 96 bp, synthetic construct
  source 1..96: mol_type = other DNA
ctacctaaaggtctcctagtgttttagagctagaaatagcaagttaaaataaggctagtccgttatcaacttgaaaaagtggcaccgagtcggtgc

SEQ ID NO: 30065 - DNA, 96 bp, synthetic construct
  source 1..96: mol_type = other DNA
gcttggatccatgtctgatggttttagagctagaaatagcaagttaaaataaggctagtccgttatcaacttgaaaaagtggcaccgagtcggtgc

SEQ ID NO: 30066 - DNA, 96 bp, synthetic construct; identical to SEQ ID NO: 30040
  source 1..96: mol_type = other DNA

SEQ ID NO: 30067 - DNA, 96 bp, synthetic construct
  source 1..96: mol_type = other DNA
tacctaaaggtctcctagtggttttagagctagaaatagcaagttaaaataaggctagtccgttatcaacttgaaaaagtggcaccgagtcggtgc

SEQ ID NO: 30068 - DNA, 96 bp, synthetic construct
  source 1..96: mol_type = other DNA
tggatccatgtctgatgtacgttttagagctagaaatagcaagttaaaataaggctagtccgttatcaacttgaaaaagtggcaccgagtcggtgc

SEQ ID NO: 30069 - DNA, 96 bp, synthetic construct
  source 1..96: mol_type = other DNA
cttggatccatgtctgatgtgttttagagctagaaatagcaagttaaaataaggctagtccgttatcaacttgaaaaagtggcaccgagtcggtgc

SEQ ID NO: 30070 - DNA, 170 bp, synthetic construct; identical to SEQ ID NO: 30027
  source 1..170: mol_type = other DNA

SEQ ID NO: 30071 - DNA, 170 bp, synthetic construct; identical to SEQ ID NO: 30027
  source 1..170: mol_type = other DNA

SEQ ID NO: 30072 - DNA, 97 bp, synthetic construct; identical to SEQ ID NO: 30023
  source 1..97: mol_type = other DNA

SEQ ID NO: 30073 - DNA, 96 bp, synthetic construct
  source 1..96: mol_type = other DNA
ttggatccatgtctgatgtagttttagagctagaaatagcaagttaaaataaggctagtccgttatcaacttgaaaaagtggcaccgagtcggtgc

SEQ ID NO: 30074 - DNA, 96 bp, synthetic construct; identical to SEQ ID NO: 30073
  source 1..96: mol_type = other DNA

SEQ ID NO: 30075 - DNA, 96 bp, synthetic construct
  source 1..96: mol_type = other DNA
acctaaaggtctcctagtgcgttttagagctagaaatagcaagttaaaataaggctagtccgttatcaacttgaaaaagtggcaccgagtcggtgc

SEQ ID NO: 30076 - DNA, 170 bp, synthetic construct
  source 1..170: mol_type = other DNA
ccactacctaaaggtctcctagtgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30077 - DNA, 170 bp, synthetic construct; identical to SEQ ID NO: 30076
  source 1..170: mol_type = other DNA

SEQ ID NO: 30078 - DNA, 97 bp, synthetic construct; identical to SEQ ID NO: 30058
  source 1..97: mol_type = other DNA

SEQ ID NO: 30079 - DNA, 96 bp, synthetic construct
  source 1..96: mol_type = other DNA
cctaaaggtctcctagtgccgttttagagctagaaatagcaagttaaaataaggctagtccgttatcaacttgaaaaagtggcaccgagtcggtgc

SEQ ID NO: 30080 - DNA, 96 bp, synthetic construct; identical to SEQ ID NO: 30068
  source 1..96: mol_type = other DNA

SEQ ID NO: 30081 - DNA, 170 bp, synthetic construct
  source 1..170: mol_type = other DNA
ttggatccatgtctgatgtactggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30082 - DNA, 97 bp, synthetic construct; identical to SEQ ID NO: 30058
  source 1..97: mol_type = other DNA

SEQ ID NO: 30083 - DNA, 96 bp, synthetic construct
  source 1..96: mol_type = other DNA
taaaggtctcctagtgcctcgttttagagctagaaatagcaagttaaaataaggctagtccgttatcaacttgaaaaagtggcaccgagtcggtgc

SEQ ID NO: 30084 - DNA, 96 bp, synthetic construct
  source 1..96: mol_type = other DNA
ctaaaggtctcctagtgcctgttttagagctagaaatagcaagttaaaataaggctagtccgttatcaacttgaaaaagtggcaccgagtcggtgc

SEQ ID NO: 30085 - DNA, 96 bp, synthetic construct
  source 1..96: mol_type = other DNA
ggatccatgtctgatgtactgttttagagctagaaatagcaagttaaaataaggctagtccgttatcaacttgaaaaagtggcaccgagtcggtgc

SEQ ID NO: 30086 - DNA, 99 bp, synthetic construct
  source 1..99: mol_type = other DNA
ctagtgcctctgactcagtggtggttttagtactctggaaacagaatctactaaaacaaggcaaaatgccgtgtttatctcgtcaacttgttggcgaga

SEQ ID NO: 30087 - DNA, 97 bp, synthetic construct; identical to SEQ ID NO: 30058
  source 1..97: mol_type = other DNA

SEQ ID NO: 30088 - DNA, 96 bp, synthetic construct; identical to SEQ ID NO: 30084
  source 1..96: mol_type = other DNA

SEQ ID NO: 30089 - DNA, 96 bp, synthetic construct; identical to SEQ ID NO: 29593
  source 1..96: mol_type = other DNA

SEQ ID NO: 30090 - DNA, 96 bp, synthetic construct; identical to SEQ ID NO: 30083
  source 1..96: mol_type = other DNA

SEQ ID NO: 30091 - DNA, 96 bp, synthetic construct; identical to SEQ ID NO: 30083
  source 1..96: mol_type = other DNA

SEQ ID NO: 30092 - DNA, 96 bp, synthetic construct
  source 1..96: mol_type = other DNA
gatccatgtctgatgtactggttttagagctagaaatagcaagttaaaataaggctagtccgttatcaacttgaaaaagtggcaccgagtcggtgc

SEQ ID NO: 30093 - DNA, 96 bp, synthetic construct; identical to SEQ ID NO: 30092
  source 1..96: mol_type = other DNA

SEQ ID NO: 30094 - DNA, 99 bp, synthetic construct; identical to SEQ ID NO: 30086
  source 1..99: mol_type = other DNA

SEQ ID NO: 30095 - DNA, 97 bp, synthetic construct
  source 1..97: mol_type = other DNA
aaggtctcctagtgcctctgagttttagtactctggaaacagaatctactaaaacaaggcaaaatgccgtgtttatctcgtcaacttgttggcgaga

SEQ ID NO: 30096 - DNA, 97 bp, synthetic construct
  source 1..97: mol_type = other DNA
tctcctagtgcctctgactcagttttagtactctggaaacagaatctactaaaacaaggcaaaatgccgtgtttatctcgtcaacttgttggcgaga

SEQ ID NO: 30097 - DNA, 97 bp, synthetic construct
  source 1..97: mol_type = other DNA
aggtctcctagtgcctctgacgttttagtactctggaaacagaatctactaaaacaaggcaaaatgccgtgtttatctcgtcaacttgttggcgaga

SEQ ID NO: 30098 - DNA, 96 bp, synthetic construct; identical to SEQ ID NO: 30084
  source 1..96: mol_type = other DNA

SEQ ID NO: 30099 - DNA, 96 bp, synthetic construct
  source 1..96: mol_type = other DNA
aaaggtctcctagtgcctctgttttagagctagaaatagcaagttaaaataaggctagtccgttatcaacttgaaaaagtggcaccgagtcggtgc

SEQ ID NO: 30100 - DNA, 96 bp, synthetic construct
  source 1..96: mol_type = other DNA
atccatgtctgatgtactgtgttttagagctagaaatagcaagttaaaataaggctagtccgttatcaacttgaaaaagtggcaccgagtcggtgc

SEQ ID NO: 30101 - DNA, 96 bp, synthetic construct; identical to SEQ ID NO: 30100
  source 1..96: mol_type = other DNA

SEQ ID NO: 30102 - DNA, 86 bp, synthetic construct
  source 1..86: mol_type = other DNA
  misc_difference 1: note = a, c, t, g, unknown or other
nagtctttgtactctggtaccagaagctacaaagataaggcttcatgccgaaatcaacaccctgtcattttatggcagggtgtttt

SEQ ID NO: 30103 - DNA, 97 bp, synthetic construct; identical to SEQ ID NO: 30095
  source 1..97: mol_type = other DNA

SEQ ID NO: 30104 - DNA, 97 bp, synthetic construct; identical to SEQ ID NO: 30097
  source 1..97: mol_type = other DNA

SEQ ID NO: 30105 - DNA, 97 bp, synthetic construct; identical to SEQ ID NO: 30039
  source 1..97: mol_type = other DNA

SEQ ID NO: 30106 - DNA, 96 bp, synthetic construct; identical to SEQ ID NO: 30083
  source 1..96: mol_type = other DNA

SEQ ID NO: 30107 - DNA, 96 bp, synthetic construct
  source 1..96: mol_type = other DNA
aaggtctcctagtgcctctggttttagagctagaaatagcaagttaaaataaggctagtccgttatcaacttgaaaaagtggcaccgagtcggtgc

SEQ ID NO: 30108 - DNA, 96 bp, synthetic construct
  source 1..96: mol_type = other DNA
tccatgtctgatgtactgtggttttagagctagaaatagcaagttaaaataaggctagtccgttatcaacttgaaaaagtggcaccgagtcggtgc

SEQ ID NO: 30109 - DNA, 86 bp, synthetic construct; identical to SEQ ID NO: 30102
  source 1..86: mol_type = other DNA
  misc_difference 1: note = a, c, t, g, unknown or other

SEQ ID NO: 30110 - DNA, 170 bp, synthetic construct; identical to SEQ ID NO: 30081
  source 1..170: mol_type = other DNA

SEQ ID NO: 30111 - DNA, 170 bp, synthetic construct; identical to SEQ ID NO: 30081
  source 1..170: mol_type = other DNA

SEQ ID NO: 30112 - DNA, 99 bp, synthetic construct; identical to SEQ ID NO: 30086
  source 1..99: mol_type = other DNA

SEQ ID NO: 30113 - DNA, 97 bp, synthetic construct; identical to SEQ ID NO: 30095
  source 1..97: mol_type = other DNA

SEQ ID NO: 30114 - DNA, 97 bp, synthetic construct
  source 1..97: mol_type = other DNA
atccatgtctgatgtactgtggttttagtactctggaaacagaatctactaaaacaaggcaaaatgccgtgtttatctcgtcaacttgttggcgaga

SEQ ID NO: 30115 - DNA, 96 bp, synthetic construct
  source 1..96: mol_type = other DNA
gtctcctagtgcctctgactgttttagagctagaaatagcaagttaaaataaggctagtccgttatcaacttgaaaaagtggcaccgagtcggtgc

SEQ ID NO: 30116 - DNA, 96 bp, synthetic construct
  source 1..96: mol_type = other DNA
aggtctcctagtgcctctgagttttagagctagaaatagcaagttaaaataaggctagtccgttatcaacttgaaaaagtggcaccgagtcggtgc

SEQ ID NO: 30117 - DNA, 96 bp, synthetic construct
  source 1..96: mol_type = other DNA
ccatgtctgatgtactgtgtgttttagagctagaaatagcaagttaaaataaggctagtccgttatcaacttgaaaaagtggcaccgagtcggtgc

SEQ ID NO: 30118 - DNA, 97 bp, synthetic construct; identical to SEQ ID NO: 30095
  source 1..97: mol_type = other DNA

SEQ ID NO: 30119 - DNA, 97 bp, synthetic construct; identical to SEQ ID NO: 30097
  source 1..97: mol_type = other DNA

SEQ ID NO: 30120 - DNA, 96 bp, synthetic construct
  source 1..96: mol_type = other DNA
tctcctagtgcctctgactcgttttagagctagaaatagcaagttaaaataaggctagtccgttatcaacttgaaaaagtggcaccgagtcggtgc

SEQ ID NO: 30121 - DNA, 96 bp, synthetic construct
  source 1..96: mol_type = other DNA
ggtctcctagtgcctctgacgttttagagctagaaatagcaagttaaaataaggctagtccgttatcaacttgaaaaagtggcaccgagtcggtgc

SEQ ID NO: 30122 - DNA, 96 bp, synthetic construct
  source 1..96: mol_type = other DNA
catgtctgatgtactgtgtggttttagagctagaaatagcaagttaaaataaggctagtccgttatcaacttgaaaaagtggcaccgagtcggtgc

SEQ ID NO: 30123 - DNA, 138 bp, synthetic construct
  source 1..138: mol_type = other DNA
ataataacttttcacttagggttttagagctagaaatagcaagttaaaataaggctagtccgttatcaacttgaaaaagtggcaccgagtcggtgcgcttctctgataagcagtactgtaggccccaagtgaaaagtt

SEQ ID NO: 30124 - DNA, 139 bp, synthetic construct
  source 1..139: mol_type = other DNA
taagcagtactgtaggccctagttttagtactctggaaacagaatctactaaaacaaggcaaaatgccgtgtttatctcgtcaacttgttggcgagaatttaacagtgataataacttttcacttggggcctacagtac

SEQ ID NO: 30125 - DNA, 138 bp, synthetic construct
  source 1..138: mol_type = other DNA
gataataacttttcacttaggttttagagctagaaatagcaagttaaaataaggctagtccgttatcaacttgaaaaagtggcaccgagtcggtgccttctctgataagcagtactgtaggccccaagtgaaaagtta

SEQ ID NO: 30126 - DNA, 138 bp, synthetic construct
  source 1..138: mol_type = other DNA
aagcagtactgtaggccctagttttagagctagaaatagcaagttaaaataaggctagtccgttatcaacttgaaaaagtggcaccgagtcggtgcatttaacagtgataataacttttcacttggggcctacagtac

SEQ ID NO: 30127 - DNA, 138 bp, synthetic construct; identical to SEQ ID NO: 30125
  source 1..138: mol_type = other DNA

SEQ ID NO: 30128 - DNA, 138 bp, synthetic construct; identical to SEQ ID NO: 30126
  source 1..138: mol_type = other DNA

SEQ ID NO: 30129 - DNA, 138 bp, synthetic construct
  source 1..138: mol_type = other DNA
tgataataacttttcacttagttttagagctagaaatagcaagttaaaataaggctagtccgttatcaacttgaaaaagtggcaccgagtcggtgcttctctgataagcagtactgtaggccccaagtgaaaagttat

SEQ ID NO: 30130 - DNA, 138 bp, synthetic construct; identical to SEQ ID NO: 30129
  source 1..138: mol_type = other DNA

SEQ ID NO: 30131 - DNA, 138 bp, synthetic construct; identical to SEQ ID NO: 30129
  source 1..138: mol_type = other DNA

SEQ ID NO: 30132 - DNA, 138 bp, synthetic construct
  source 1..138: mol_type = other DNA
taagcagtactgtaggccctgttttagagctagaaatagcaagttaaaataaggctagtccgttatcaacttgaaaaagtggcaccgagtcggtgctttaacagtgataataacttttcacttggggcctacagtact

SEQ ID NO: 30133 - DNA, 138 bp, synthetic construct; identical to SEQ ID NO: 30132
  source 1..138: mol_type = other DNA

SEQ ID NO: 30134 - DNA, 138 bp, synthetic construct; identical to SEQ ID NO: 30129
  source 1..138: mol_type = other DNA

SEQ ID NO: 30135 - DNA, 212 bp, synthetic construct
  source 1..212: mol_type = other DNA
cagtgataataacttttcacttagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctttctctgataagcagtactgtaggccccaagtgaaaagttat

SEQ ID NO: 30136 - DNA, 187 bp, synthetic construct
  source 1..187: mol_type = other DNA
aacagtgataataacttttcacttgttgtagctccctttctcatttcggaaacgaaatgagaaccgttgctacaataaggccgtctgaaaagatgtgccgcaacgctctgccccttaaagcttctgctttaaggggcatcgtttatctctgataagcagtactgtaggccccaagtgaaaagttatt

SEQ ID NO: 30137 - DNA, 139 bp, synthetic construct
  source 1..139: mol_type = other DNA
agtgataataacttttcacttgttttagtactctggaaacagaatctactaaaacaaggcaaaatgccgtgtttatctcgtcaacttgttggcgagatctctgataagcagtactgtaggccccaagtgaaaagttatt

SEQ ID NO: 30138 - DNA, 139 bp, synthetic construct; identical to SEQ ID NO: 30137
  source 1..139: mol_type = other DNA

SEQ ID NO: 30139 - DNA, 139 bp, synthetic construct
  source 1..139: mol_type = other DNA
gataagcagtactgtaggcccgttttagtactctggaaacagaatctactaaaacaaggcaaaatgccgtgtttatctcgtcaacttgttggcgagattaacagtgataataacttttcacttggggcctacagtactg

SEQ ID NO: 30140 - DNA, 138 bp, synthetic construct
  source 1..138: mol_type = other DNA
gtgataataacttttcacttgttttagagctagaaatagcaagttaaaataaggctagtccgttatcaacttgaaaaagtggcaccgagtcggtgctctctgataagcagtactgtaggccccaagtgaaaagttatt

SEQ ID NO: 30141 - DNA, 138 bp, synthetic construct; identical to SEQ ID NO: 30140
  source 1..138: mol_type = other DNA

SEQ ID NO: 30142 - DNA, 138 bp, synthetic construct; identical to SEQ ID NO: 30140
  source 1..138: mol_type = other DNA

SEQ ID NO: 30143 - DNA, 138 bp, synthetic construct; identical to SEQ ID NO: 30140
  source 1..138: mol_type = other DNA

SEQ ID NO: 30144 - DNA, 138 bp, synthetic construct
  source 1..138: mol_type = other DNA
ataagcagtactgtaggcccgttttagagctagaaatagcaagttaaaataaggctagtccgttatcaacttgaaaaagtggcaccgagtcggtgcttaacagtgataataacttttcacttggggcctacagtactg

SEQ ID NO: 30145 - DNA, 212 bp, synthetic construct
  source 1..212: mol_type = other DNA
acagtgataataacttttcacttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttctctgataagcagtactgtaggccccaagtgaaaagttatt

SEQ ID NO: 30146 - DNA, 212 bp, synthetic construct; identical to SEQ ID NO: 30145
  source 1..212: mol_type = other DNA

SEQ ID NO: 30147 - DNA, 141 bp, synthetic construct
  source 1..141: mol_type = other DNA
aacagtgataataacttttcactgttttagtactctggaaacagaatctactaaaacaaggcaaaatgccgtgtttatctcgtcaacttgttggcgagactctgataagcagtactgtaggccccaagtgaaaagttatta

SEQ ID NO: 30148 - DNA, 139 bp, synthetic construct
  source 1..139: mol_type = other DNA
cagtgataataacttttcactgttttagtactctggaaacagaatctactaaaacaaggcaaaatgccgtgtttatctcgtcaacttgttggcgagactctgataagcagtactgtaggccccaagtgaaaagttatta

SEQ ID NO: 30149 - DNA, 139 bp, synthetic construct
  source 1..139: mol_type = other DNA
tgataagcagtactgtaggccgttttagtactctggaaacagaatctactaaaacaaggcaaaatgccgtgtttatctcgtcaacttgttggcgagataacagtgataataacttttcacttggggcctacagtactgc

SEQ ID NO: 30150 - DNA, 139 bp, synthetic construct; identical to SEQ ID NO: 30149
  source 1..139: mol_type = other DNA

SEQ ID NO: 30151 - DNA, 139 bp, synthetic construct; identical to SEQ ID NO: 30148
  source 1..139: mol_type = other DNA

SEQ ID NO: 30152 - DNA, 139 bp, synthetic construct; identical to SEQ ID NO: 30148
  source 1..139: mol_type = other DNA

SEQ ID NO: 30153 - DNA, 138 bp, synthetic construct
  source 1..138: mol_type = other DNA
agtgataataacttttcactgttttagagctagaaatagcaagttaaaataaggctagtccgttatcaacttgaaaaagtggcaccgagtcggtgcctctgataagcagtactgtaggccccaagtgaaaagttatta

SEQ ID NO: 30154 - DNA, 138 bp, synthetic construct; identical to SEQ ID NO: 30153
  source 1..138: mol_type = other DNA

SEQ ID NO: 30155 - DNA, 138 bp, synthetic construct
  source 1..138: mol_type = other DNA
gataagcagtactgtaggccgttttagagctagaaatagcaagttaaaataaggctagtccgttatcaacttgaaaaagtggcaccgagtcggtgctaacagtgataataacttttcacttggggcctacagtactgc

SEQ ID NO: 30156 - DNA, 139 bp, synthetic construct
  source 1..139: mol_type = other DNA
ctgataagcagtactgtaggcgttttagtactctggaaacagaatctactaaaacaaggcaaaatgccgtgtttatctcgtcaacttgttggcgagaaacagtgataataacttttcacttggggcctacagtactgct

SEQ ID NO: 30157 - DNA, 139 bp, synthetic construct
  source 1..139: mol_type = other DNA
acagtgataataacttttcacgttttagtactctggaaacagaatctactaaaacaaggcaaaatgccgtgtttatctcgtcaacttgttggcgagatctgataagcagtactgtaggccccaagtgaaaagttattat

SEQ ID NO: 30158 - DNA, 139 bp, synthetic construct; identical to SEQ ID NO: 30157
  source 1..139: mol_type = other DNA

SEQ ID NO: 30159 - DNA, 138 bp, synthetic construct
  source 1..138: mol_type = other DNA
tgataagcagtactgtaggcgttttagagctagaaatagcaagttaaaataaggctagtccgttatcaacttgaaaaagtggcaccgagtcggtgcaacagtgataataacttttcacttggggcctacagtactgct

SEQ ID NO: 30160 - DNA, 138 bp, synthetic construct
  source 1..138: mol_type = other DNA
cagtgataataacttttcacgttttagagctagaaatagcaagttaaaataaggctagtccgttatcaacttgaaaaagtggcaccgagtcggtgctctgataagcagtactgtaggccccaagtgaaaagttattat

SEQ ID NO: 30161 - DNA, 139 bp, synthetic construct
  source 1..139: mol_type = other DNA
aacagtgataataacttttcagttttagtactctggaaacagaatctactaaaacaaggcaaaatgccgtgtttatctcgtcaacttgttggcgagactgataagcagtactgtaggccccaagtgaaaagttattatc

SEQ ID NO: 30162 - DNA, 138 bp, synthetic construct
  source 1..138: mol_type = other DNA
ctgataagcagtactgtagggttttagagctagaaatagcaagttaaaataaggctagtccgttatcaacttgaaaaagtggcaccgagtcggtgcacagtgataataacttttcacttggggcctacagtactgctt

SEQ ID NO: 30163 - DNA, 138 bp, synthetic construct
  source 1..138: mol_type = other DNA
acagtgataataacttttcagttttagagctagaaatagcaagttaaaataaggctagtccgttatcaacttgaaaaagtggcaccgagtcggtgcctgataagcagtactgtaggccccaagtgaaaagttattatc

SEQ ID NO: 30164 - DNA, 138 bp, synthetic construct
  source 1..138: mol_type = other DNA
tctgataagcagtactgtaggttttagagctagaaatagcaagttaaaataaggctagtccgttatcaacttgaaaaagtggcaccgagtcggtgccagtgataataacttttcacttggggcctacagtactgctta

SEQ ID NO: 30165 - DNA, 138 bp, synthetic construct
  source 1..138: mol_type = other DNA
aacagtgataataacttttcgttttagagctagaaatagcaagttaaaataaggctagtccgttatcaacttgaaaaagtggcaccgagtcggtgctgataagcagtactgtaggccccaagtgaaaagttattatca

SEQ ID NO: 30166 - DNA, 138 bp, synthetic construct
  source 1..138: mol_type = other DNA
ctctgataagcagtactgtagttttagagctagaaatagcaagttaaaataaggctagtccgttatcaacttgaaaaagtggcaccgagtcggtgcagtgataataacttttcacttggggcctacagtactgcttat

SEQ ID NO: 30167 - DNA, 138 bp, synthetic construct; identical to SEQ ID NO: 30166
  source 1..138: mol_type = other DNA

SEQ ID NO: 30168 - DNA, 138 bp, synthetic construct
  source 1..138: mol_type = other DNA
taacagtgataataacttttgttttagagctagaaatagcaagttaaaataaggctagtccgttatcaacttgaaaaagtggcaccgagtcggtgcgataagcagtactgtaggccccaagtgaaaagttattatcac

SEQ ID NO: 30169 - DNA, 212 bp, synthetic construct
  source 1..212: mol_type = other DNA
cttctctgataagcagtactgtagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctagtgataataacttttcacttggggcctacagtactgcttat

SEQ ID NO: 30170 - DNA, 212 bp, synthetic construct; identical to SEQ ID NO: 30169
  source 1..212: mol_type = other DNA

SEQ ID NO: 30171 - DNA, 212 bp, synthetic construct; identical to SEQ ID NO: 30169
  source 1..212: mol_type = other DNA

SEQ ID NO: 30172 - DNA, 187 bp, synthetic construct
  source 1..187: mol_type = other DNA
ggcttctctgataagcagtactgtgttgtagctccctttctcatttcggaaacgaaatgagaaccgttgctacaataaggccgtctgaaaagatgtgccgcaacgctctgccccttaaagcttctgctttaaggggcatcgtttagtgataataacttttcacttggggcctacagtactgcttatc

SEQ ID NO: 30173 - DNA, 138 bp, synthetic construct
  source 1..138: mol_type = other DNA
tctctgataagcagtactgtgttttagagctagaaatagcaagttaaaataaggctagtccgttatcaacttgaaaaagtggcaccgagtcggtgcgtgataataacttttcacttggggcctacagtactgcttatc

SEQ ID NO: 30174 - DNA, 138 bp, synthetic construct; identical to SEQ ID NO: 30173
  source 1..138: mol_type = other DNA

SEQ ID NO: 30175 - DNA, 138 bp, synthetic construct; identical to SEQ ID NO: 30173
  source 1..138: mol_type = other DNA

SEQ ID NO: 30176 - DNA, 138 bp, synthetic construct; identical to SEQ ID NO: 30173
  source 1..138: mol_type = other DNA

SEQ ID NO: 30177 - DNA, 138 bp, synthetic construct
  source 1..138: mol_type = other DNA
ttaacagtgataataactttgttttagagctagaaatagcaagttaaaataaggctagtccgttatcaacttgaaaaagtggcaccgagtcggtgcataagcagtactgtaggccccaagtgaaaagttattatcact

SEQ ID NO: 30178 - DNA, 212 bp, synthetic construct
  source 1..212: mol_type = other DNA
gcttctctgataagcagtactgtgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgtgataataacttttcacttggggcctacagtactgcttatc

SEQ ID NO: 30179 - DNA, 212 bp, synthetic construct; identical to SEQ ID NO: 30178
  source 1..212: mol_type = other DNA

SEQ ID NO: 30180 - DNA, 187 bp, synthetic construct
  source 1..187: mol_type = other DNA
tggcttctctgataagcagtactggttgtagctccctttctcatttcggaaacgaaatgagaaccgttgctacaataaggccgtctgaaaagatgtgccgcaacgctctgccccttaaagcttctgctttaaggggcatcgtttatgataataacttttcacttggggcctacagtactgcttatca

SEQ ID NO: 30181 - DNA, 139 bp, synthetic construct
  source 1..139: mol_type = other DNA
cttctctgataagcagtactggttttagtactctggaaacagaatctactaaaacaaggcaaaatgccgtgtttatctcgtcaacttgttggcgagatgataataacttttcacttggggcctacagtactgcttatca

SEQ ID NO: 30182 - DNA, 139 bp, synthetic construct; identical to SEQ ID NO: 30181
  source 1..139: mol_type = other DNA

SEQ ID NO: 30183 - DNA, 138 bp, synthetic construct
  source 1..138: mol_type = other DNA
ttctctgataagcagtactggttttagagctagaaatagcaagttaaaataaggctagtccgttatcaacttgaaaaagtggcaccgagtcggtgctgataataacttttcacttggggcctacagtactgcttatca

SEQ ID NO: 30184 - DNA, 138 bp, synthetic construct; identical to SEQ ID NO: 30183
  source 1..138: mol_type = other DNA

SEQ ID NO: 30185 - DNA, 138 bp, synthetic construct
  source 1..138: mol_type = other DNA
tttaacagtgataataacttgttttagagctagaaatagcaagttaaaataaggctagtccgttatcaacttgaaaaagtggcaccgagtcggtgctaagcagtactgtaggccccaagtgaaaagttattatcactg

SEQ ID NO: 30186 - DNA, 212 bp, synthetic construct
  source 1..212: mol_type = other DNA
tgatttaacagtgataataacttgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttaagcagtactgtaggccccaagtgaaaagttattatcactg

SEQ ID NO: 30187 - DNA, 212 bp, synthetic construct
  source 1..212: mol_type = other DNA
ggcttctctgataagcagtactggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttgataataacttttcacttggggcctacagtactgcttatca

SEQ ID NO: 30188 - DNA, 212 bp, synthetic construct; identical to SEQ ID NO: 30186
  source 1..212: mol_type = other DNA

SEQ ID NO: 30189 - DNA, 139 bp, synthetic construct
  source 1..139: mol_type = other DNA
gcttctctgataagcagtactgttttagtactctggaaacagaatctactaaaacaaggcaaaatgccgtgtttatctcgtcaacttgttggcgagagataataacttttcacttggggcctacagtactgcttatcag

SEQ ID NO: 30190 - DNA, 139 bp, synthetic construct; identical to SEQ ID NO: 30189
  source 1..139: mol_type = other DNA

SEQ ID NO: 30191 - DNA, 138 bp, synthetic construct
  source 1..138: mol_type = other DNA
cttctctgataagcagtactgttttagagctagaaatagcaagttaaaataaggctagtccgttatcaacttgaaaaagtggcaccgagtcggtgcgataataacttttcacttggggcctacagtactgcttatcag

SEQ ID NO: 30192 - DNA, 138 bp, synthetic construct
  source 1..138: mol_type = other DNA
atttaacagtgataataactgttttagagctagaaatagcaagttaaaataaggctagtccgttatcaacttgaaaaagtggcaccgagtcggtgcaagcagtactgtaggccccaagtgaaaagttattatcactgt

SEQ ID NO: 30193 - DNA, 139 bp, synthetic construct
  source 1..139: mol_type = other DNA
ggcttctctgataagcagtacgttttagtactctggaaacagaatctactaaaacaaggcaaaatgccgtgtttatctcgtcaacttgttggcgagaataataacttttcacttggggcctacagtactgcttatcaga

SEQ ID NO: 30194 - DNA, 138 bp, synthetic construct
  source 1..138: mol_type = other DNA
gcttctctgataagcagtacgttttagagctagaaatagcaagttaaaataaggctagtccgttatcaacttgaaaaagtggcaccgagtcggtgcataataacttttcacttggggcctacagtactgcttatcaga

SEQ ID NO: 30195 - DNA, 138 bp, synthetic construct; identical to SEQ ID NO: 30194
  source 1..138: mol_type = other DNA

SEQ ID NO: 30196 - DNA, 138 bp, synthetic construct
  source 1..138: mol_type = other DNA
gatttaacagtgataataacgttttagagctagaaatagcaagttaaaataaggctagtccgttatcaacttgaaaaagtggcaccgagtcggtgcagcagtactgtaggccccaagtgaaaagttattatcactgtt

SEQ ID NO: 30197 - DNA, 212 bp, synthetic construct
  source 1..212: mol_type = other DNA
cctgatttaacagtgataataacgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctagcagtactgtaggccccaagtgaaaagttattatcactgtt

SEQ ID NO: 30198 - DNA, 138 bp, synthetic construct
  source 1..138: mol_type = other DNA
ggcttctctgataagcagtagttttagagctagaaatagcaagttaaaataaggctagtccgttatcaacttgaaaaagtggcaccgagtcggtgctaataacttttcacttggggcctacagtactgcttatcagag

SEQ ID NO: 30199 - DNA, 138 bp, synthetic construct; identical to SEQ ID NO: 30198
  source 1..138: mol_type = other DNA

SEQ ID NO: 30200 - DNA, 138 bp, synthetic construct
  source 1..138: mol_type = other DNA
tgatttaacagtgataataagttttagagctagaaatagcaagttaaaataaggctagtccgttatcaacttgaaaaagtggcaccgagtcggtgcgcagtactgtaggccccaagtgaaaagttattatcactgtta

SEQ ID NO: 30201 - DNA, 138 bp, synthetic construct
  source 1..138: mol_type = other DNA
tggcttctctgataagcagtgttttagagctagaaatagcaagttaaaataaggctagtccgttatcaacttgaaaaagtggcaccgagtcggtgcaataacttttcacttggggcctacagtactgcttatcagaga

SEQ ID NO: 30202 - DNA, 138 bp, synthetic construct
  source 1..138: mol_type = other DNA
ctgatttaacagtgataatagttttagagctagaaatagcaagttaaaataaggctagtccgttatcaacttgaaaaagtggcaccgagtcggtgccagtactgtaggccccaagtgaaaagttattatcactgttaa

SEQ ID NO: 30203 - DNA, 138 bp, synthetic construct
  source 1..138: mol_type = other DNA
ttggcttctctgataagcaggttttagagctagaaatagcaagttaaaataaggctagtccgttatcaacttgaaaaagtggcaccgagtcggtgcataacttttcacttggggcctacagtactgcttatcagagaa

SEQ ID NO: 30204 - DNA, 138 bp, synthetic construct
  source 1..138: mol_type = other DNA
cctgatttaacagtgataatgttttagagctagaaatagcaagttaaaataaggctagtccgttatcaacttgaaaaagtggcaccgagtcggtgcagtactgtaggccccaagtgaaaagttattatcactgttaaa

SEQ ID NO: 30205 - DNA, 138 bp, synthetic construct
  source 1..138: mol_type = other DNA
tcctgatttaacagtgataagttttagagctagaaatagcaagttaaaataaggctagtccgttatcaacttgaaaaagtggcaccgagtcggtgcgtactgtaggccccaagtgaaaagttattatcactgttaaat

SEQ ID NO: 30206 - DNA, 138 bp, synthetic construct
  source 1..138: mol_type = other DNA
tttggcttctctgataagcagttttagagctagaaatagcaagttaaaataaggctagtccgttatcaacttgaaaaagtggcaccgagtcggtgctaacttttcacttggggcctacagtactgcttatcagagaag

SEQ ID NO: 30207 - DNA, 138 bp, synthetic construct
  source 1..138: mol_type = other DNA
ctttggcttctctgataagcgttttagagctagaaatagcaagttaaaataaggctagtccgttatcaacttgaaaaagtggcaccgagtcggtgcaacttttcacttggggcctacagtactgcttatcagagaagc

SEQ ID NO: 30208 - DNA, 138 bp, synthetic construct; identical to SEQ ID NO: 30207
  source 1..138: mol_type = other DNA

SEQ ID NO: 30209 - DNA, 138 bp, synthetic construct
  source 1..138: mol_type = other DNA
atcctgatttaacagtgatagttttagagctagaaatagcaagttaaaataaggctagtccgttatcaacttgaaaaagtggcaccgagtcggtgctactgtaggccccaagtgaaaagttattatcactgttaaatc

SEQ ID NO: 30210 - DNA, 212 bp, synthetic construct
  source 1..212: mol_type = other DNA
aagctttggcttctctgataagcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctaacttttcacttggggcctacagtactgcttatcagagaagc

SEQ ID NO: 30211 - DNA, 212 bp, synthetic construct
  source 1..212: mol_type = other DNA
ctgatcctgatttaacagtgatagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgcttactgtaggccccaagtgaaaagttattatcactgttaaatc

SEQ ID NO: 30212 - DNA, 212 bp, synthetic construct; identical to SEQ ID NO: 30210
  source 1..212: mol_type = other DNA

SEQ ID NO: 30213 - DNA, 212 bp, synthetic construct; identical to SEQ ID NO: 30211
  source 1..212: mol_type = other DNA

SEQ ID NO: 30214 - DNA, 139 bp, synthetic construct
  source 1..139: mol_type = other DNA
tgatcctgatttaacagtgatgttttagtactctggaaacagaatctactaaaacaaggcaaaatgccgtgtttatctcgtcaacttgttggcgagaactgtaggccccaagtgaaaagttattatcactgttaaatca

SEQ ID NO: 30215 - DNA, 138 bp, synthetic construct
  source 1..138: mol_type = other DNA
gctttggcttctctgataaggttttagagctagaaatagcaagttaaaataaggctagtccgttatcaacttgaaaaagtggcaccgagtcggtgcacttttcacttggggcctacagtactgcttatcagagaagcc

SEQ ID NO: 30216 - DNA, 138 bp, synthetic construct; identical to SEQ ID NO: 30215
  source 1..138: mol_type = other DNA

SEQ ID NO: 30217 - DNA, 138 bp, synthetic construct
  source 1..138: mol_type = other DNA
gatcctgatttaacagtgatgttttagagctagaaatagcaagttaaaataaggctagtccgttatcaacttgaaaaagtggcaccgagtcggtgcactgtaggccccaagtgaaaagttattatcactgttaaatca

SEQ ID NO: 30218 - DNA, 139 bp, synthetic construct
  source 1..139: mol_type = other DNA
aagctttggcttctctgataagttttagtactctggaaacagaatctactaaaacaaggcaaaatgccgtgtttatctcgtcaacttgttggcgagacttttcacttggggcctacagtactgcttatcagagaagcca

SEQ ID NO: 30219 - DNA, 138 bp, synthetic construct
  source 1..138: mol_type = other DNA
tgatcctgatttaacagtgagttttagagctagaaatagcaagttaaaataaggctagtccgttatcaacttgaaaaagtggcaccgagtcggtgcctgtaggccccaagtgaaaagttattatcactgttaaatcag

SEQ ID NO: 30220 - DNA, 138 bp, synthetic construct
  source 1..138: mol_type = other DNA
agctttggcttctctgataagttttagagctagaaatagcaagttaaaataaggctagtccgttatcaacttgaaaaagtggcaccgagtcggtgccttttcacttggggcctacagtactgcttatcagagaagcca

SEQ ID NO: 30221 - DNA, 139 bp, synthetic construct
  source 1..139: mol_type = other DNA
gaagctttggcttctctgatagttttagtactctggaaacagaatctactaaaacaaggcaaaatgccgtgtttatctcgtcaacttgttggcgagattttcacttggggcctacagtactgcttatcagagaagccaa

SEQ ID NO: 30222 - DNA, 139 bp, synthetic construct; identical to SEQ ID NO: 30221
  source 1..139: mol_type = other DNA

SEQ ID NO: 30223 - DNA, 138 bp, synthetic construct
  source 1..138: mol_type = other DNA
aagctttggcttctctgatagttttagagctagaaatagcaagttaaaataaggctagtccgttatcaacttgaaaaagtggcaccgagtcggtgcttttcacttggggcctacagtactgcttatcagagaagccaa

SEQ ID NO: 30224 - DNA, 138 bp, synthetic construct; identical to SEQ ID NO: 30223
  source 1..138: mol_type = other DNA

SEQ ID NO: 30225 - DNA, 138 bp, synthetic construct
  source 1..138: mol_type = other DNA
ctgatcctgatttaacagtggttttagagctagaaatagcaagttaaaataaggctagtccgttatcaacttgaaaaagtggcaccgagtcggtgctgtaggccccaagtgaaaagttattatcactgttaaatcagg

SEQ ID NO: 30226 - DNA, 139 bp, synthetic construct
  source 1..139: mol_type = other DNA
tactgatcctgatttaacagtgttttagtactctggaaacagaatctactaaaacaaggcaaaatgccgtgtttatctcgtcaacttgttggcgagagtaggccccaagtgaaaagttattatcactgttaaatcagga

SEQ ID NO: 30227 - DNA, 139 bp, synthetic construct; identical to SEQ ID NO: 30226
  source 1..139: mol_type = other DNA

SEQ ID NO: 30228 - DNA, 138 bp, synthetic construct
  source 1..138: mol_type = other DNA
gaagctttggcttctctgatgttttagagctagaaatagcaagttaaaataaggctagtccgttatcaacttgaaaaagtggcaccgagtcggtgctttcacttggggcctacagtactgcttatcagagaagccaaa

SEQ ID NO: 30229 - DNA, 138 bp, synthetic construct; identical to SEQ ID NO: 30228
  source 1..138: mol_type = other DNA

SEQ ID NO: 30230 - DNA, 138 bp, synthetic construct
  source 1..138: mol_type = other DNA
actgatcctgatttaacagtgttttagagctagaaatagcaagttaaaataaggctagtccgttatcaacttgaaaaagtggcaccgagtcggtgcgtaggccccaagtgaaaagttattatcactgttaaatcagga

SEQ ID NO: 30231 - DNA, 139 bp, synthetic construct
  source 1..139: mol_type = other DNA
gagaagctttggcttctctgagttttagtactctggaaacagaatctactaaaacaaggcaaaatgccgtgtttatctcgtcaacttgttggcgagattcacttggggcctacagtactgcttatcagagaagccaaag

SEQ ID NO: 30232 - DNA, 138 bp, synthetic construct
  source 1..138: mol_type = other DNA
tactgatcctgatttaacaggttttagagctagaaatagcaagttaaaataaggctagtccgttatcaacttgaaaaagtggcaccgagtcggtgctaggccccaagtgaaaagttattatcactgttaaatcaggat

SEQ ID NO: 30233 - DNA, 138 bp, synthetic construct
  source 1..138: mol_type = other DNA
agaagctttggcttctctgagttttagagctagaaatagcaagttaaaataaggctagtccgttatcaacttgaaaaagtggcaccgagtcggtgcttcacttggggcctacagtactgcttatcagagaagccaaag

SEQ ID NO: 30234 - DNA, 138 bp, synthetic construct; identical to SEQ ID NO: 30232
  source 1..138: mol_type = other DNA

SEQ ID NO: 30235 - DNA, 212 bp, synthetic construct
  source 1..212: mol_type = other DNA
gggagaagctttggcttctctgagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctttcacttggggcctacagtactgcttatcagagaagccaaag

SEQ ID NO: 30236 - DNA, 212 bp, synthetic construct; identical to SEQ ID NO: 30235
  source 1..212: mol_type = other DNA

SEQ ID NO: 30237 - DNA, 139 bp, synthetic construct
  source 1..139: mol_type = other DNA
ggagaagctttggcttctctggttttagtactctggaaacagaatctactaaaacaaggcaaaatgccgtgtttatctcgtcaacttgttggcgagatcacttggggcctacagtactgcttatcagagaagccaaagc

SEQ ID NO: 30238 - DNA, 138 bp, synthetic construct
  source 1..138: mol_type = other DNA
atactgatcctgatttaacagttttagagctagaaatagcaagttaaaataaggctagtccgttatcaacttgaaaaagtggcaccgagtcggtgcaggccccaagtgaaaagttattatcactgttaaatcaggatc

SEQ ID NO: 30239 - DNA, 138 bp, synthetic construct; identical to SEQ ID NO: 30238
  source 1..138: mol_type = other DNA

SEQ ID NO: 30240 - DNA, 138 bp, synthetic construct
  source 1..138: mol_type = other DNA
gagaagctttggcttctctggttttagagctagaaatagcaagttaaaataaggctagtccgttatcaacttgaaaaagtggcaccgagtcggtgctcacttggggcctacagtactgcttatcagagaagccaaagc

SEQ ID NO: 30241 - DNA, 139 bp, synthetic construct
  source 1..139: mol_type = other DNA
gggagaagctttggcttctctgttttagtactctggaaacagaatctactaaaacaaggcaaaatgccgtgtttatctcgtcaacttgttggcgagacacttggggcctacagtactgcttatcagagaagccaaagct

SEQ ID NO: 30242 - DNA, 139 bp, synthetic construct
  source 1..139: mol_type = other DNA
gaatactgatcctgatttaacgttttagtactctggaaacagaatctactaaaacaaggcaaaatgccgtgtttatctcgtcaacttgttggcgagaggccccaagtgaaaagttattatcactgttaaatcaggatca

SEQ ID NO: 30243 - DNA, 139 bp, synthetic construct; identical to SEQ ID NO: 30242
  source 1..139: mol_type = other DNA

SEQ ID NO: 30244 - DNA, 138 bp, synthetic construct
  source 1..138: mol_type = other DNA
aatactgatcctgatttaacgttttagagctagaaatagcaagttaaaataaggctagtccgttatcaacttgaaaaagtggcaccgagtcggtgcggccccaagtgaaaagttattatcactgttaaatcaggatca

SEQ ID NO: 30245 - DNA, 138 bp, synthetic construct
  source 1..138: mol_type = other DNA
ggagaagctttggcttctctgttttagagctagaaatagcaagttaaaataaggctagtccgttatcaacttgaaaaagtggcaccgagtcggtgccacttggggcctacagtactgcttatcagagaagccaaagct

SEQ ID NO: 30246 - DNA, 138 bp, synthetic construct; identical to SEQ ID NO: 30244
  source 1..138: mol_type = other DNA

SEQ ID NO: 30247 - DNA, 138 bp, synthetic construct
  source 1..138: mol_type = other DNA
gaatactgatcctgatttaagttttagagctagaaatagcaagttaaaataaggctagtccgttatcaacttgaaaaagtggcaccgagtcggtgcgccccaagtgaaaagttattatcactgttaaatcaggatcag

SEQ ID NO: 30248 - DNA, 138 bp, synthetic construct; identical to SEQ ID NO: 30247
  source 1..138: mol_type = other DNA

SEQ ID NO: 30249 - DNA, 138 bp, synthetic construct
  source 1..138: mol_type = other DNA
gggagaagctttggcttctcgttttagagctagaaatagcaagttaaaataaggctagtccgttatcaacttgaaaaagtggcaccgagtcggtgcacttggggcctacagtactgcttatcagagaagccaaagctt

SEQ ID NO: 30250 - DNA, 138 bp, synthetic construct; identical to SEQ ID NO: 30249
  source 1..138: mol_type = other DNA

SEQ ID NO: 30251 - DNA, 139 bp, synthetic construct
  source 1..139: mol_type = other DNA
gggaatactgatcctgatttagttttagtactctggaaacagaatctactaaaacaaggcaaaatgccgtgtttatctcgtcaacttgttggcgagaccccaagtgaaaagttattatcactgttaaatcaggatcagt

SEQ ID NO: 30252 - DNA, 138 bp, synthetic construct
  source 1..138: mol_type = other DNA
ggggagaagctttggcttctgttttagagctagaaatagcaagttaaaataaggctagtccgttatcaacttgaaaaagtggcaccgagtcggtgccttggggcctacagtactgcttatcagagaagccaaagcttc

SEQ ID NO: 30253 - DNA, 138 bp, synthetic construct; identical to SEQ ID NO: 30252
  source 1..138: mol_type = other DNA

SEQ ID NO: 30254 - DNA, 138 bp, synthetic construct
  source 1..138: mol_type = other DNA
ggaatactgatcctgatttagttttagagctagaaatagcaagttaaaataaggctagtccgttatcaacttgaaaaagtggcaccgagtcggtgcccccaagtgaaaagttattatcactgttaaatcaggatcagt

SEQ ID NO: 30255 - DNA, 139 bp, synthetic construct
  source 1..139: mol_type = other DNA
agggggagaagctttggcttcgttttagtactctggaaacagaatctactaaaacaaggcaaaatgccgtgtttatctcgtcaacttgttggcgagattggggcctacagtactgcttatcagagaagccaaagcttct

SEQ ID NO: 30256 - DNA, 139 bp, synthetic construct
  source 1..139: mol_type = other DNA
agggaatactgatcctgatttgttttagtactctggaaacagaatctactaaaacaaggcaaaatgccgtgtttatctcgtcaacttgttggcgagacccaagtgaaaagttattatcactgttaaatcaggatcagta

SEQ ID NO: 30257 - DNA, 139 bp, synthetic construct; identical to SEQ ID NO: 30255
  source 1..139: mol_type = other DNA

SEQ ID NO: 30258 - DNA, 139 bp, synthetic construct; identical to SEQ ID NO: 30256
  source 1..139: mol_type = other DNA

SEQ ID NO: 30259 - DNA, 138 bp, synthetic construct
  source 1..138: mol_type = other DNA
gggaatactgatcctgatttgttttagagctagaaatagcaagttaaaataaggctagtccgttatcaacttgaaaaagtggcaccgagtcggtgccccaagtgaaaagttattatcactgttaaatcaggatcagta

SEQ ID NO: 30260 - DNA, 138 bp, synthetic construct
  source 1..138: mol_type = other DNA
gggggagaagctttggcttcgttttagagctagaaatagcaagttaaaataaggctagtccgttatcaacttgaaaaagtggcaccgagtcggtgcttggggcctacagtactgcttatcagagaagccaaagcttct

SEQ ID NO: 30261 - DNA, 138 bp, synthetic construct
  source 1..138: mol_type = other DNA
agggaatactgatcctgattgttttagagctagaaatagcaagttaaaataaggctagtccgttatcaacttgaaaaagtggcaccgagtcggtgcccaagtgaaaagttattatcactgttaaatcaggatcagtat

SEQ ID NO: 30262 - DNA, 138 bp, synthetic construct
  source 1..138: mol_type = other DNA
agggggagaagctttggcttgttttagagctagaaatagcaagttaaaataaggctagtccgttatcaacttgaaaaagtggcaccgagtcggtgctggggcctacagtactgcttatcagagaagccaaagcttctc

SEQ ID NO: 30263 - DNA, 138 bp, synthetic construct
  source 1..138: mol_type = other DNA
cagggggagaagctttggctgttttagagctagaaatagcaagttaaaataaggctagtccgttatcaacttgaaaaagtggcaccgagtcggtgcggggcctacagtactgcttatcagagaagccaaagcttctcc

SEQ ID NO: 30264 - DNA, 138 bp, synthetic construct
  source 1..138: mol_type = other DNA
cagggaatactgatcctgatgttttagagctagaaatagcaagttaaaataaggctagtccgttatcaacttgaaaaagtggcaccgagtcggtgccaagtgaaaagttattatcactgttaaatcaggatcagtatt

SEQ ID NO: 30265 - DNA, 212 bp, synthetic construct
  source 1..212: mol_type = other DNA
cagcagggaatactgatcctgatgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctcaagtgaaaagttattatcactgttaaatcaggatcagtatt

SEQ ID NO: 30266 - DNA, 212 bp, synthetic construct; identical to SEQ ID NO: 30265
  source 1..212: mol_type = other DNA

SEQ ID NO: 30267 - DNA, 139 bp, synthetic construct
  source 1..139: mol_type = other DNA
agcagggaatactgatcctgagttttagtactctggaaacagaatctactaaaacaaggcaaaatgccgtgtttatctcgtcaacttgttggcgagaaagtgaaaagttattatcactgttaaatcaggatcagtattc

SEQ ID NO: 30268 - DNA, 138 bp, synthetic construct
  source 1..138: mol_type = other DNA
ccagggggagaagctttggcgttttagagctagaaatagcaagttaaaataaggctagtccgttatcaacttgaaaaagtggcaccgagtcggtgcgggcctacagtactgcttatcagagaagccaaagcttctccc

SEQ ID NO: 30269 - DNA, 138 bp, synthetic construct
  source 1..138: mol_type = other DNA
gcagggaatactgatcctgagttttagagctagaaatagcaagttaaaataaggctagtccgttatcaacttgaaaaagtggcaccgagtcggtgcaagtgaaaagttattatcactgttaaatcaggatcagtattc

SEQ ID NO: 30270 - DNA, 212 bp, synthetic construct
  source 1..212: mol_type = other DNA
gctccagggggagaagctttggcgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgctgggcctacagtactgcttatcagagaagccaaagcttctccc

SEQ ID NO: 30271 - DNA, 212 bp, synthetic construct; identical to SEQ ID NO: 30270
  source 1..212: mol_type = other DNA

SEQ ID NO: 30272 - DNA, 96 bp, synthetic construct
  source 1..96: mol_type = other DNA
tctctgccacgtaatagagggttttagagctagaaatagcaagttaaaataaggctagtccgttatcaacttgaaaaagtggcaccgagtcggtgc

SEQ ID NO: 30273 - DNA, 97 bp, synthetic construct
  source 1..97: mol_type = other DNA
gcatttgggctgtgatgtagagttttagtactctggaaacagaatctactaaaacaaggcaaaatgccgtgtttatctcgtcaacttgttggcgaga

SEQ ID NO: 30274 - DNA, 96 bp, synthetic construct; identical to SEQ ID NO: 30272
  source 1..96: mol_type = other DNA

SEQ ID NO: 30275 - DNA, 96 bp, synthetic construct
  source 1..96: mol_type = other DNA
atttgggctgtgatgtagaagttttagagctagaaatagcaagttaaaataaggctagtccgttatcaacttgaaaaagtggcaccgagtcggtgc

SEQ ID NO: 30276 - DNA, 96 bp, synthetic construct
  source 1..96: mol_type = other DNA
ctctgccacgtaatagaggggttttagagctagaaatagcaagttaaaataaggctagtccgttatcaacttgaaaaagtggcaccgagtcggtgc

SEQ ID NO: 30277 - DNA, 96 bp, synthetic construct
  source 1..96: mol_type = other DNA
tttgggctgtgatgtagaaggttttagagctagaaatagcaagttaaaataaggctagtccgttatcaacttgaaaaagtggcaccgagtcggtgc

SEQ ID NO: 30278 - DNA, 96 bp, synthetic construct
  source 1..96: mol_type = other DNA
tctgccacgtaatagagggggttttagagctagaaatagcaagttaaaataaggctagtccgttatcaacttgaaaaagtggcaccgagtcggtgc

SEQ ID NO: 30279 - DNA, 96 bp, synthetic construct
  source 1..96: mol_type = other DNA
ctgccacgtaatagaggggcgttttagagctagaaatagcaagttaaaataaggctagtccgttatcaacttgaaaaagtggcaccgagtcggtgc

SEQ ID NO: 30280 - DNA, 96 bp, synthetic construct; identical to SEQ ID NO: 30278
  source 1..96: mol_type = other DNA

SEQ ID NO: 30281 - DNA, 96 bp, synthetic construct
  source 1..96: mol_type = other DNA
gggctgtgatgtagaaggaagttttagagctagaaatagcaagttaaaataaggctagtccgttatcaacttgaaaaagtggcaccgagtcggtgc

SEQ ID NO: 30282 - DNA, 96 bp, synthetic construct
  source 1..96: mol_type = other DNA
ttgggctgtgatgtagaagggttttagagctagaaatagcaagttaaaataaggctagtccgttatcaacttgaaaaagtggcaccgagtcggtgc

SEQ ID NO: 30283 - DNA, 96 bp, synthetic construct; identical to SEQ ID NO: 30279
  source 1..96: mol_type = other DNA

SEQ ID NO: 30284 - DNA, 170 bp, synthetic construct
  source 1..170: mol_type = other DNA
ctctgccacgtaatagaggggctgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30285 - DNA, 145 bp, synthetic construct
  source 1..145: mol_type = other DNA
tctgccacgtaatagaggggctgggttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 30286 - DNA, 97 bp, synthetic construct
  source 1..97: mol_type = other DNA
ctctgccacgtaatagagggggttttagtactctggaaacagaatctactaaaacaaggcaaaatgccgtgtttatctcgtcaacttgttggcgaga

SEQ ID NO: 30287 - DNA, 97 bp, synthetic construct; identical to SEQ ID NO: 30286
  source 1..97: mol_type = other DNA

SEQ ID NO: 30288 - DNA, 97 bp, synthetic construct
  source 1..97: mol_type = other DNA
tgggctgtgatgtagaaggaagttttagtactctggaaacagaatctactaaaacaaggcaaaatgccgtgtttatctcgtcaacttgttggcgaga

SEQ ID NO: 30289 - DNA, 96 bp, synthetic construct; identical to SEQ ID NO: 30279
  source 1..96: mol_type = other DNA

SEQ ID NO: 30290 - DNA, 96 bp, synthetic construct; identical to SEQ ID NO: 30279
  source 1..96: mol_type = other DNA

SEQ ID NO: 30291 - DNA, 96 bp, synthetic construct; identical to SEQ ID NO: 30279
  source 1..96: mol_type = other DNA

SEQ ID NO: 30292 - DNA, 96 bp, synthetic construct; identical to SEQ ID NO: 30279
  source 1..96: mol_type = other DNA

SEQ ID NO: 30293 - DNA, 96 bp, synthetic construct
  source 1..96: mol_type = other DNA
tgggctgtgatgtagaaggagttttagagctagaaatagcaagttaaaataaggctagtccgttatcaacttgaaaaagtggcaccgagtcggtgc

SEQ ID NO: 30294 - DNA, 170 bp, synthetic construct; identical to SEQ ID NO: 30284
  source 1..170: mol_type = other DNA

SEQ ID NO: 30295 - DNA, 170 bp, synthetic construct; identical to SEQ ID NO: 30284
  source 1..170: mol_type = other DNA

SEQ ID NO: 30296 - DNA, 99 bp, synthetic construct
  source 1..99: mol_type = other DNA
tctctgccacgtaatagaggggcgttttagtactctggaaacagaatctactaaaacaaggcaaaatgccgtgtttatctcgtcaacttgttggcgaga

SEQ ID NO: 30297 - DNA, 97 bp, synthetic construct
  source 1..97: mol_type = other DNA
tctgccacgtaatagaggggcgttttagtactctggaaacagaatctactaaaacaaggcaaaatgccgtgtttatctcgtcaacttgttggcgaga

SEQ ID NO: 30298 - DNA, 97 bp, synthetic construct; identical to SEQ ID NO: 30288
  source 1..97: mol_type = other DNA

SEQ ID NO: 30299 - DNA, 97 bp, synthetic construct; identical to SEQ ID NO: 30288
  source 1..97: mol_type = other DNA

SEQ ID NO: 30300 - DNA, 97 bp, synthetic construct; identical to SEQ ID NO: 30286
  source 1..97: mol_type = other DNA

SEQ ID NO: 30301 - DNA, 97 bp, synthetic construct; identical to SEQ ID NO: 30286
  source 1..97: mol_type = other DNA

SEQ ID NO: 30302 - DNA, 96 bp, synthetic construct; identical to SEQ ID NO: 30279
  source 1..96: mol_type = other DNA

SEQ ID NO: 30303 - DNA, 96 bp, synthetic construct
  source 1..96: mol_type = other DNA
tgccacgtaatagaggggctgttttagagctagaaatagcaagttaaaataaggctagtccgttatcaacttgaaaaagtggcaccgagtcggtgc

SEQ ID NO: 30304 - DNA, 96 bp, synthetic construct; identical to SEQ ID NO: 30281
  source 1..96: mol_type = other DNA

SEQ ID NO: 30305 - DNA, 97 bp, synthetic construct
  source 1..97: mol_type = other DNA
gggctgtgatgtagaaggaatgttttagtactctggaaacagaatctactaaaacaaggcaaaatgccgtgtttatctcgtcaacttgttggcgaga

SEQ ID NO: 30306 - DNA, 97 bp, synthetic construct; identical to SEQ ID NO: 30297
  source 1..97: mol_type = other DNA

SEQ ID NO: 30307 - DNA, 97 bp, synthetic construct; identical to SEQ ID NO: 30286
  source 1..97: mol_type = other DNA

SEQ ID NO: 30308 - DNA, 96 bp, synthetic construct
  source 1..96: mol_type = other DNA
ggctgtgatgtagaaggaatgttttagagctagaaatagcaagttaaaataaggctagtccgttatcaacttgaaaaagtggcaccgagtcggtgc

SEQ ID NO: 30309 - DNA, 96 bp, synthetic construct
  source 1..96: mol_type = other DNA
gccacgtaatagaggggctggttttagagctagaaatagcaagttaaaataaggctagtccgttatcaacttgaaaaagtggcaccgagtcggtgc

SEQ ID NO: 30310 - DNA, 97 bp, synthetic construct; identical to SEQ ID NO: 30297
  source 1..97: mol_type = other DNA

SEQ ID NO: 30311 - DNA, 96 bp, synthetic construct
  source 1..96: mol_type = other DNA
gctgtgatgtagaaggaatcgttttagagctagaaatagcaagttaaaataaggctagtccgttatcaacttgaaaaagtggcaccgagtcggtgc

SEQ ID NO: 30312 - DNA, 96 bp, synthetic construct
  source 1..96: mol_type = other DNA
ccacgtaatagaggggctgggttttagagctagaaatagcaagttaaaataaggctagtccgttatcaacttgaaaaagtggcaccgagtcggtgc

SEQ ID NO: 30313 - DNA, 96 bp, synthetic construct
  source 1..96: mol_type = other DNA
ctgtgatgtagaaggaatcggttttagagctagaaatagcaagttaaaataaggctagtccgttatcaacttgaaaaagtggcaccgagtcggtgc

SEQ ID NO: 30314 - DNA, 96 bp, synthetic construct
  source 1..96: mol_type = other DNA
cacgtaatagaggggctggagttttagagctagaaatagcaagttaaaataaggctagtccgttatcaacttgaaaaagtggcaccgagtcggtgc

SEQ ID NO: 30315 - DNA, 96 bp, synthetic construct
  source 1..96: mol_type = other DNA
tgtgatgtagaaggaatcgggttttagagctagaaatagcaagttaaaataaggctagtccgttatcaacttgaaaaagtggcaccgagtcggtgc

SEQ ID NO: 30316 - DNA, 96 bp, synthetic construct; identical to SEQ ID NO: 30315
  source 1..96: mol_type = other DNA

SEQ ID NO: 30317 - DNA, 96 bp, synthetic construct
  source 1..96: mol_type = other DNA
acgtaatagaggggctggaagttttagagctagaaatagcaagttaaaataaggctagtccgttatcaacttgaaaaagtggcaccgagtcggtgc

SEQ ID NO: 30318 - DNA, 170 bp, synthetic construct
  source 1..170: mol_type = other DNA
gcatttgggctgtgatgtagaaggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30319 - DNA, 170 bp, synthetic construct; identical to SEQ ID NO: 30318
  source 1..170: mol_type = other DNA

SEQ ID NO: 30320 - DNA, 170 bp, synthetic construct; identical to SEQ ID NO: 30318
  source 1..170: mol_type = other DNA

SEQ ID NO: 30321 - DNA, 145 bp, synthetic construct
  source 1..145: mol_type = other DNA
ggtgagatgagagaaggggcacaagttgtagctccctttctcatttcggaaacgaaatgagaaccgttgctacaataaggccgtctgaaaagatgtgccgcaacgctctgccccttaaagcttctgctttaaggggcatcgttta

SEQ ID NO: 30322 - DNA, 96 bp, synthetic construct
  source 1..96: mol_type = other DNA
gtgatgtagaaggaatcggggttttagagctagaaatagcaagttaaaataaggctagtccgttatcaacttgaaaaagtggcaccgagtcggtgc

SEQ ID NO: 30323 - DNA, 96 bp, synthetic construct; identical to SEQ ID NO: 30313
  source 1..96: mol_type = other DNA

SEQ ID NO: 30324 - DNA, 96 bp, synthetic construct; identical to SEQ ID NO: 30322
  source 1..96: mol_type = other DNA

SEQ ID NO: 30325 - DNA, 96 bp, synthetic construct; identical to SEQ ID NO: 30315
  source 1..96: mol_type = other DNA

SEQ ID NO: 30326 - DNA, 96 bp, synthetic construct
  source 1..96: mol_type = other DNA
cgtaatagaggggctggaacgttttagagctagaaatagcaagttaaaataaggctagtccgttatcaacttgaaaaagtggcaccgagtcggtgc

SEQ ID NO: 30327 - DNA, 170 bp, synthetic construct; identical to SEQ ID NO: 30318
  source 1..170: mol_type = other DNA

SEQ ID NO: 30328 - DNA, 170 bp, synthetic construct; identical to SEQ ID NO: 30318
  source 1..170: mol_type = other DNA

SEQ ID NO: 30329 - DNA, 145 bp, synthetic construct; identical to SEQ ID NO: 30321
  source 1..145: mol_type = other DNA

SEQ ID NO: 30330 - DNA, 97 bp, synthetic construct
  source 1..97: mol_type = other DNA
ggctgtgatgtagaaggaatcgttttagtactctggaaacagaatctactaaaacaaggcaaaatgccgtgtttatctcgtcaacttgttggcgaga

SEQ ID NO: 30331 - DNA, 97 bp, synthetic construct
  source 1..97: mol_type = other DNA
gtgatgtagaaggaatcgggggttttagtactctggaaacagaatctactaaaacaaggcaaaatgccgtgtttatctcgtcaacttgttggcgaga

SEQ ID NO: 30332 - DNA, 96 bp, synthetic construct; identical to SEQ ID NO: 30322
  source 1..96: mol_type = other DNA

SEQ ID NO: 30333 - DNA, 96 bp, synthetic construct
  source 1..96: mol_type = other DNA
tgatgtagaaggaatcgggggttttagagctagaaatagcaagttaaaataaggctagtccgttatcaacttgaaaaagtggcaccgagtcggtgc

SEQ ID NO: 30334 - DNA, 96 bp, synthetic construct
  source 1..96: mol_type = other DNA
gtaatagaggggctggaactgttttagagctagaaatagcaagttaaaataaggctagtccgttatcaacttgaaaaagtggcaccgagtcggtgc

SEQ ID NO: 30335 - DNA, 170 bp, synthetic construct
  source 1..170: mol_type = other DNA
cgtaatagaggggctggaactccgctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30336 - DNA, 170 bp, synthetic construct; identical to SEQ ID NO: 30318
  source 1..170: mol_type = other DNA

SEQ ID NO: 30337 - DNA, 170 bp, synthetic construct; identical to SEQ ID NO: 30335
  source 1..170: mol_type = other DNA

SEQ ID NO: 30338 - DNA, 97 bp, synthetic construct; identical to SEQ ID NO: 30331
  source 1..97: mol_type = other DNA

SEQ ID NO: 30339 - DNA, 97 bp, synthetic construct; identical to SEQ ID NO: 30331
  source 1..97: mol_type = other DNA

SEQ ID NO: 30340 - DNA, 96 bp, synthetic construct
  source 1..96: mol_type = other DNA
gatgtagaaggaatcggggtgttttagagctagaaatagcaagttaaaataaggctagtccgttatcaacttgaaaaagtggcaccgagtcggtgc

SEQ ID NO: 30341 - DNA, 96 bp, synthetic construct
  source 1..96: mol_type = other DNA
taatagaggggctggaactcgttttagagctagaaatagcaagttaaaataaggctagtccgttatcaacttgaaaaagtggcaccgagtcggtgc

SEQ ID NO: 30342 - DNA, 97 bp, synthetic construct
  source 1..97: mol_type = other DNA
atgtagaaggaatcggggtgagttttagtactctggaaacagaatctactaaaacaaggcaaaatgccgtgtttatctcgtcaacttgttggcgaga

SEQ ID NO: 30343 - DNA, 96 bp, synthetic construct
  source 1..96: mol_type = other DNA
atgtagaaggaatcggggtggttttagagctagaaatagcaagttaaaataaggctagtccgttatcaacttgaaaaagtggcaccgagtcggtgc

SEQ ID NO: 30344 - DNA, 96 bp, synthetic construct; identical to SEQ ID NO: 30343
  source 1..96: mol_type = other DNA

SEQ ID NO: 30345 - DNA, 96 bp, synthetic construct
  source 1..96: mol_type = other DNA
aatagaggggctggaactccgttttagagctagaaatagcaagttaaaataaggctagtccgttatcaacttgaaaaagtggcaccgagtcggtgc

SEQ ID NO: 30346 - DNA, 170 bp, synthetic construct; identical to SEQ ID NO: 30335
  source 1..170: mol_type = other DNA

SEQ ID NO: 30347 - DNA, 96 bp, synthetic construct
  source 1..96: mol_type = other DNA
gtagaaggaatcggggtgaggttttagagctagaaatagcaagttaaaataaggctagtccgttatcaacttgaaaaagtggcaccgagtcggtgc

SEQ ID NO: 30348 - DNA, 96 bp, synthetic construct
  source 1..96: mol_type = other DNA
tgtagaaggaatcggggtgagttttagagctagaaatagcaagttaaaataaggctagtccgttatcaacttgaaaaagtggcaccgagtcggtgc

SEQ ID NO: 30349 - DNA, 96 bp, synthetic construct
  source 1..96: mol_type = other DNA
atagaggggctggaactccggttttagagctagaaatagcaagttaaaataaggctagtccgttatcaacttgaaaaagtggcaccgagtcggtgc

SEQ ID NO: 30350 - DNA, 96 bp, synthetic construct; identical to SEQ ID NO: 30347
  source 1..96: mol_type = other DNA

SEQ ID NO: 30351 - DNA, 96 bp, synthetic construct
  source 1..96: mol_type = other DNA
tagaggggctggaactccgtgttttagagctagaaatagcaagttaaaataaggctagtccgttatcaacttgaaaaagtggcaccgagtcggtgc

SEQ ID NO: 30352 - DNA, 96 bp, synthetic construct
  source 1..96: mol_type = other DNA
tagaaggaatcggggtgagagttttagagctagaaatagcaagttaaaataaggctagtccgttatcaacttgaaaaagtggcaccgagtcggtgc

SEQ ID NO: 30353 - DNA, 96 bp, synthetic construct
  source 1..96: mol_type = other DNA
agaggggctggaactccgtggttttagagctagaaatagcaagttaaaataaggctagtccgttatcaacttgaaaaagtggcaccgagtcggtgc

SEQ ID NO: 30354 - DNA, 96 bp, synthetic construct
  source 1..96: mol_type = other DNA
gaggggctggaactccgtgagttttagagctagaaatagcaagttaaaataaggctagtccgttatcaacttgaaaaagtggcaccgagtcggtgc

SEQ ID NO: 30355 - DNA, 96 bp, synthetic construct
  source 1..96: mol_type = other DNA
agaaggaatcggggtgagatgttttagagctagaaatagcaagttaaaataaggctagtccgttatcaacttgaaaaagtggcaccgagtcggtgc

SEQ ID NO: 30356 - DNA, 96 bp, synthetic construct
  source 1..96: mol_type = other DNA
gaaggaatcggggtgagatggttttagagctagaaatagcaagttaaaataaggctagtccgttatcaacttgaaaaagtggcaccgagtcggtgc

SEQ ID NO: 30357 - DNA, 96 bp, synthetic construct; identical to SEQ ID NO: 30356
  source 1..96: mol_type = other DNA

SEQ ID NO: 30358 - DNA, 96 bp, synthetic construct
  source 1..96: mol_type = other DNA
aggggctggaactccgtgacgttttagagctagaaatagcaagttaaaataaggctagtccgttatcaacttgaaaaagtggcaccgagtcggtgc

SEQ ID NO: 30359 - DNA, 170 bp, synthetic construct
  source 1..170: mol_type = other DNA
ggaatcggggtgagatgagagaagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30360 - DNA, 170 bp, synthetic construct; identical to SEQ ID NO: 30335
  source 1..170: mol_type = other DNA

SEQ ID NO: 30361 - DNA, 170 bp, synthetic construct; identical to SEQ ID NO: 30359
  source 1..170: mol_type = other DNA

SEQ ID NO: 30362 - DNA, 170 bp, synthetic construct; identical to SEQ ID NO: 30335
  source 1..170: mol_type = other DNA

SEQ ID NO: 30363 - DNA, 97 bp, synthetic construct
  source 1..97: mol_type = other DNA
ggggctggaactccgtgacaggttttagtactctggaaacagaatctactaaaacaaggcaaaatgccgtgtttatctcgtcaacttgttggcgaga

SEQ ID NO: 30364 - DNA, 96 bp, synthetic construct
  source 1..96: mol_type = other DNA
aaggaatcggggtgagatgagttttagagctagaaatagcaagttaaaataaggctagtccgttatcaacttgaaaaagtggcaccgagtcggtgc

SEQ ID NO: 30365 - DNA, 96 bp, synthetic construct; identical to SEQ ID NO: 30364
  source 1..96: mol_type = other DNA

SEQ ID NO: 30366 - DNA, 96 bp, synthetic construct
  source 1..96: mol_type = other DNA
ggggctggaactccgtgacagttttagagctagaaatagcaagttaaaataaggctagtccgttatcaacttgaaaaagtggcaccgagtcggtgc

SEQ ID NO: 30367 - DNA, 97 bp, synthetic construct
  source 1..97: mol_type = other DNA
aggaatcggggtgagatgagagttttagtactctggaaacagaatctactaaaacaaggcaaaatgccgtgtttatctcgtcaacttgttggcgaga

SEQ ID NO: 30368 - DNA, 96 bp, synthetic construct
  source 1..96: mol_type = other DNA
gggctggaactccgtgacaggttttagagctagaaatagcaagttaaaataaggctagtccgttatcaacttgaaaaagtggcaccgagtcggtgc

SEQ ID NO: 30369 - DNA, 96 bp, synthetic construct
  source 1..96: mol_type = other DNA
aggaatcggggtgagatgaggttttagagctagaaatagcaagttaaaataaggctagtccgttatcaacttgaaaaagtggcaccgagtcggtgc

SEQ ID NO: 30370 - DNA, 97 bp, synthetic construct; identical to SEQ ID NO: 30367
  source 1..97: mol_type = other DNA

SEQ ID NO: 30371 - DNA, 97 bp, synthetic construct; identical to SEQ ID NO: 30367
  source 1..97: mol_type = other DNA

SEQ ID NO: 30372 - DNA, 96 bp, synthetic construct; identical to SEQ ID NO: 30369
  source 1..96: mol_type = other DNA

SEQ ID NO: 30373 - DNA, 96 bp, synthetic construct
  source 1..96: mol_type = other DNA
ggaatcggggtgagatgagagttttagagctagaaatagcaagttaaaataaggctagtccgttatcaacttgaaaaagtggcaccgagtcggtgc

SEQ ID NO: 30374 - DNA, 96 bp, synthetic construct
  source 1..96: mol_type = other DNA
ggctggaactccgtgacagtgttttagagctagaaatagcaagttaaaataaggctagtccgttatcaacttgaaaaagtggcaccgagtcggtgc

SEQ ID NO: 30375 - DNA, 97 bp, synthetic construct; identical to SEQ ID NO: 30363
  source 1..97: mol_type = other DNA

SEQ ID NO: 30376 - DNA, 97 bp, synthetic construct; identical to SEQ ID NO: 30363
  source 1..97: mol_type = other DNA

SEQ ID NO: 30377 - DNA, 96 bp, synthetic construct
  source 1..96: mol_type = other DNA
gaatcggggtgagatgagaggttttagagctagaaatagcaagttaaaataaggctagtccgttatcaacttgaaaaagtggcaccgagtcggtgc

SEQ ID NO: 30378 - DNA, 96 bp, synthetic construct; identical to SEQ ID NO: 30377
  source 1..96: mol_type = other DNA

SEQ ID NO: 30379 - DNA, 96 bp, synthetic construct
  source 1..96: mol_type = other DNA
gctggaactccgtgacagtggttttagagctagaaatagcaagttaaaataaggctagtccgttatcaacttgaaaaagtggcaccgagtcggtgc

SEQ ID NO: 30380 - DNA, 97 bp, synthetic construct
  source 1..97: mol_type = other DNA
gaatcggggtgagatgagagagttttagtactctggaaacagaatctactaaaacaaggcaaaatgccgtgtttatctcgtcaacttgttggcgaga

SEQ ID NO: 30381 - DNA, 96 bp, synthetic construct; identical to SEQ ID NO: 30368
  source 1..96: mol_type = other DNA

SEQ ID NO: 30382 - DNA, 96 bp, synthetic construct
  source 1..96: mol_type = other DNA
aatcggggtgagatgagagagttttagagctagaaatagcaagttaaaataaggctagtccgttatcaacttgaaaaagtggcaccgagtcggtgc

SEQ ID NO: 30383 - DNA, 96 bp, synthetic construct
  source 1..96: mol_type = other DNA
ctggaactccgtgacagtgtgttttagagctagaaatagcaagttaaaataaggctagtccgttatcaacttgaaaaagtggcaccgagtcggtgc

SEQ ID NO: 30384 - DNA, 170 bp, synthetic construct; identical to SEQ ID NO: 30359
  source 1..170: mol_type = other DNA

SEQ ID NO: 30385 - DNA, 170 bp, synthetic construct; identical to SEQ ID NO: 30359
  source 1..170: mol_type = other DNA

SEQ ID NO: 30386 - DNA, 97 bp, synthetic construct; identical to SEQ ID NO: 30380
  source 1..97: mol_type = other DNA

SEQ ID NO: 30387 - DNA, 96 bp, synthetic construct
  source 1..96: mol_type = other DNA
aactccgtgacagtgtaattgttttagagctagaaatagcaagttaaaataaggctagtccgttatcaacttgaaaaagtggcaccgagtcggtgc

SEQ ID NO: 30388 - DNA, 96 bp, synthetic construct
  source 1..96: mol_type = other DNA
tggaactccgtgacagtgtagttttagagctagaaatagcaagttaaaataaggctagtccgttatcaacttgaaaaagtggcaccgagtcggtgc

SEQ ID NO: 30389 - DNA, 96 bp, synthetic construct
  source 1..96: mol_type = other DNA
atcggggtgagatgagagaagttttagagctagaaatagcaagttaaaataaggctagtccgttatcaacttgaaaaagtggcaccgagtcggtgc

SEQ ID NO: 30390 - DNA, 97 bp, synthetic construct; identical to SEQ ID NO: 30380
  source 1..97: mol_type = other DNA

SEQ ID NO: 30391 - DNA, 97 bp, synthetic construct
  source 1..97: mol_type = other DNA
ggaactccgtgacagtgtaatgttttagtactctggaaacagaatctactaaaacaaggcaaaatgccgtgtttatctcgtcaacttgttggcgaga

SEQ ID NO: 30392 - DNA, 97 bp, synthetic construct; identical to SEQ ID NO: 30391
  source 1..97: mol_type = other DNA

SEQ ID NO: 30393 - DNA, 96 bp, synthetic construct
  source 1..96: mol_type = other DNA
actccgtgacagtgtaatttgttttagagctagaaatagcaagttaaaataaggctagtccgttatcaacttgaaaaagtggcaccgagtcggtgc

SEQ ID NO: 30394 - DNA, 96 bp, synthetic construct
  source 1..96: mol_type = other DNA
tcggggtgagatgagagaaggttttagagctagaaatagcaagttaaaataaggctagtccgttatcaacttgaaaaagtggcaccgagtcggtgc

SEQ ID NO: 30395 - DNA, 96 bp, synthetic construct
  source 1..96: mol_type = other DNA
ggaactccgtgacagtgtaagttttagagctagaaatagcaagttaaaataaggctagtccgttatcaacttgaaaaagtggcaccgagtcggtgc

SEQ ID NO: 30396 - DNA, 96 bp, synthetic construct; identical to SEQ ID NO: 30387
  source 1..96: mol_type = other DNA

SEQ ID NO: 30397 - DNA, 96 bp, synthetic construct
  source 1..96: mol_type = other DNA
gaactccgtgacagtgtaatgttttagagctagaaatagcaagttaaaataaggctagtccgttatcaacttgaaaaagtggcaccgagtcggtgc

SEQ ID NO: 30398 - DNA, 96 bp, synthetic construct
  source 1..96: mol_type = other DNA
cggggtgagatgagagaagggttttagagctagaaatagcaagttaaaataaggctagtccgttatcaacttgaaaaagtggcaccgagtcggtgc

SEQ ID NO: 30399 - DNA, 96 bp, synthetic construct; identical to SEQ ID NO: 30398
  source 1..96: mol_type = other DNA

SEQ ID NO: 30400 - DNA, 97 bp, synthetic construct
  source 1..97: mol_type = other DNA
gaactccgtgacagtgtaattgttttagtactctggaaacagaatctactaaaacaaggcaaaatgccgtgtttatctcgtcaacttgttggcgaga

SEQ ID NO: 30401 - DNA, 96 bp, synthetic construct; identical to SEQ ID NO: 30394
  source 1..96: mol_type = other DNA

SEQ ID NO: 30402 - DNA, 96 bp, synthetic construct
  source 1..96: mol_type = other DNA
ggggtgagatgagagaaggggttttagagctagaaatagcaagttaaaataaggctagtccgttatcaacttgaaaaagtggcaccgagtcggtgc

SEQ ID NO: 30403 - DNA, 96 bp, synthetic construct; identical to SEQ ID NO: 30387
  source 1..96: mol_type = other DNA

SEQ ID NO: 30404 - DNA, 97 bp, synthetic construct
  source 1..97: mol_type = other DNA
ggggtgagatgagagaagggggttttagtactctggaaacagaatctactaaaacaaggcaaaatgccgtgtttatctcgtcaacttgttggcgaga

SEQ ID NO: 30405 - DNA, 97 bp, synthetic construct; identical to SEQ ID NO: 30400
  source 1..97: mol_type = other DNA

SEQ ID NO: 30406 - DNA, 97 bp, synthetic construct; identical to SEQ ID NO: 30404
  source 1..97: mol_type = other DNA

SEQ ID NO: 30407 - DNA, 97 bp, synthetic construct; identical to SEQ ID NO: 30400
  source 1..97: mol_type = other DNA

SEQ ID NO: 30408 - DNA, 96 bp, synthetic construct; identical to SEQ ID NO: 30393
  source 1..96: mol_type = other DNA

SEQ ID NO: 30409 - DNA, 96 bp, synthetic construct
  source 1..96: mol_type = other DNA
gggtgagatgagagaagggggttttagagctagaaatagcaagttaaaataaggctagtccgttatcaacttgaaaaagtggcaccgagtcggtgc

SEQ ID NO: 30410 - DNA, 96 bp, synthetic construct
  source 1..96: mol_type = other DNA
ctccgtgacagtgtaattttgttttagagctagaaatagcaagttaaaataaggctagtccgttatcaacttgaaaaagtggcaccgagtcggtgc

SEQ ID NO: 30411 - DNA, 96 bp, synthetic construct
  source 1..96: mol_type = other DNA
ggtgagatgagagaaggggcgttttagagctagaaatagcaagttaaaataaggctagtccgttatcaacttgaaaaagtggcaccgagtcggtgc

SEQ ID NO: 30412 - DNA, 96 bp, synthetic construct
  source 1..96: mol_type = other DNA
gtgagatgagagaaggggcagttttagagctagaaatagcaagttaaaataaggctagtccgttatcaacttgaaaaagtggcaccgagtcggtgc

SEQ ID NO: 30413 - DNA, 96 bp, synthetic construct
  source 1..96: mol_type = other DNA
tccgtgacagtgtaattttggttttagagctagaaatagcaagttaaaataaggctagtccgttatcaacttgaaaaagtggcaccgagtcggtgc

SEQ ID NO: 30414 - DNA, 170 bp, synthetic construct
  source 1..170: mol_type = other DNA
actccgtgacagtgtaattttgggctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30415 - DNA, 170 bp, synthetic construct; identical to SEQ ID NO: 30414
  source 1..170: mol_type = other DNA

SEQ ID NO: 30416 - DNA, 97 bp, synthetic construct
  source 1..97: mol_type = other DNA
ctccgtgacagtgtaattttggttttagtactctggaaacagaatctactaaaacaaggcaaaatgccgtgtttatctcgtcaacttgttggcgaga

SEQ ID NO: 30417 - DNA, 96 bp, synthetic construct
  source 1..96: mol_type = other DNA
tgagatgagagaaggggcacgttttagagctagaaatagcaagttaaaataaggctagtccgttatcaacttgaaaaagtggcaccgagtcggtgc

SEQ ID NO: 30418 - DNA, 96 bp, synthetic construct
  source 1..96: mol_type = other DNA
ccgtgacagtgtaattttgggttttagagctagaaatagcaagttaaaataaggctagtccgttatcaacttgaaaaagtggcaccgagtcggtgc

SEQ ID NO: 30419 - DNA, 170 bp, synthetic construct
  source 1..170: mol_type = other DNA
gtgagatgagagaaggggcacaagctatagttccttactgaaaggtaagttgctatagtaagggcaacagacccgaggcgttggggatcgcctagcccgtgtttacgggctctccccatattcaaaataatgacagacgagcaccttggagcatttatctccgaggtgct

SEQ ID NO: 30420 - DNA, 170 bp, synthetic construct; identical to SEQ ID NO: 30419
  source 1..170: mol_type = other DNA

SEQ ID NO: 30421 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl adenosine phosphorothioate
  modified_base 122: mod_base = OTHER; note = 2'-O-methyl cytidine
ggatggtcctcatgaacgacgttttagagctagaaatagcaagttaaaataaggctagtccgttatcaacttgaaaaagtggcaccgagtcggtgcttaccgctccagtcgttcatgaggac

SEQ ID NO: 30422 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl adenosine phosphorothioate
  modified_base 120: mod_base = OTHER; note = 2'-O-methyl guanosine phosphorothioate
  modified_base 121: mod_base = OTHER; note = 2'-O-methyl guanosine
ggatggtcctcatgaacgacgttttagagctagaaatagcaagttaaaataaggctagtccgttatcaacttgaaaaagtggcaccgagtcggtgcattaccgctccagtcgttcatgagg

SEQ ID NO: 30423 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl cytidine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl uridine phosphorothioate
  modified_base 125: mod_base = OTHER; note = 2'-O-methyl uridine phosphorothioate
  modified_base 126: mod_base = OTHER; note = 2'-O-methyl cytidine
tcagaggaagctgggccaccgttttagagctagaaatagcaagttaaaataaggctagtccgttatcaacttgaaaaagtggcaccgagtcggtgctggagcggtaatggctggtggcccagcttc

SEQ ID NO: 30424 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl cytidine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl cytidine phosphorothioate
  modified_base 127: mod_base = OTHER; note = 2'-O-methyl cytidine phosphorothioate
  modified_base 128: mod_base = OTHER; note = 2'-O-methyl uridine
tcagaggaagctgggccaccgttttagagctagaaatagcaagttaaaataaggctagtccgttatcaacttgaaaaagtggcaccgagtcggtgctggagcggtaatggctggtggcccagcttcct

SEQ ID NO: 30425 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl guanosine phosphorothioate
  modified_base 126: mod_base = OTHER; note = 2'-O-methyl adenosine phosphorothioate
  modified_base 127: mod_base = OTHER; note = 2'-O-methyl cytidine
ggatggtcctcatgaacgacgttttagagctagaaatagcaagttaaaataaggctagtccgttatcaacttgaaaaagtggcaccgagtcggtgcaggcattaccgctccagtcgttcatgaggac

SEQ ID NO: 30426 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl adenosine phosphorothioate
  modified_base 124: mod_base = OTHER; note = 2'-O-methyl guanosine phosphorothioate
  modified_base 125: mod_base = OTHER; note = 2'-O-methyl guanosine
ggatggtcctcatgaacgacgttttagagctagaaatagcaagttaaaataaggctagtccgttatcaacttgaaaaagtggcaccgagtcggtgcaggcattaccgctccagtcgttcatgagg

SEQ ID NO: 30427 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 30428 - protein, 2122 aa, synthetic construct
MPAAKRVKLDGGDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPSGGSKRTADGSEFEKRTADGSEFESPKKKAKVE

SEQ ID NO: 30429 - RNA, 122 nt, synthetic construct; identical to SEQ ID NO: 30421
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl adenosine phosphorothioate
  modified_base 122: mod_base = OTHER; note = 2'-O-methyl cytidine

SEQ ID NO: 30430 - RNA, 121 nt, synthetic construct; identical to SEQ ID NO: 30422
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl adenosine phosphorothioate
  modified_base 120: mod_base = OTHER; note = 2'-O-methyl guanosine phosphorothioate
  modified_base 121: mod_base = OTHER; note = 2'-O-methyl guanosine

SEQ ID NO: 30431 - RNA, 126 nt, synthetic construct; identical to SEQ ID NO: 30423
  source 1..126: mol_type = other RNA
  modified_base 1: mod_base = OTHER; note = 2'-O-methyl uridine phosphorothioate
  modified_base 2: mod_base = OTHER; note = 2'-O-methyl cytidine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl uridine phosphorothioate
  modified_base 125: mod_base = OTHER; note = 2'-O-methyl uridine phosphorothioate
  modified_base 126: mod_base = OTHER; note = 2'-O-methyl cytidine

SEQ ID NO: 30432 - RNA, 128 nt, synthetic construct; identical to SEQ ID NO: 30424
  source 1..128: mol_type = other RNA
  modified_base 1: mod_base = OTHER; note = 2'-O-methyl uridine phosphorothioate
  modified_base 2: mod_base = OTHER; note = 2'-O-methyl cytidine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl cytidine phosphorothioate
  modified_base 127: mod_base = OTHER; note = 2'-O-methyl cytidine phosphorothioate
  modified_base 128: mod_base = OTHER; note = 2'-O-methyl uridine

SEQ ID NO: 30433 - RNA, 6369 nt, synthetic construct
  source 1..6369: mol_type = other RNA
atgcctgcggctaagcgggtaaaattggatggtggggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaatcggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggaggatctagcggaggatcctctggcagcgagacaccaggaacaagcgagtcagcaacaccagagagcagtggcggcagcagcggcggcagcagcaccctaaatatagaagatgagtatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaggacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttaatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggaaggcaggcttctgtcgcctcttcatccctgggtttgcagaaatggcagcccccctgtaccctctcaccaaaccggggactctgtttaattggggcccagaccaacaaaaggcctatcaagaaatcaagcaagcccttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggtggctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcaccctctggcggctcaaaaagaaccgccgacggcagcgaattcgagaaaaggacggcggatggtagcgaattcgagagccctaaaaagaaggccaaggtagagtaa

SEQ ID NO: 30434 - RNA, 100 nt, synthetic construct
  source 1..100: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
acacaaataccagtccagcggttttagagctagaaatagcaagttaaaataaggctagtccgttatcaacttgaaaaagtggcaccgagtcggtgctttt

SEQ ID NO: 30435 - RNA, 6369 nt, synthetic construct; identical to SEQ ID NO: 30433
  source 1..6369: mol_type = other RNA

SEQ ID NO: 30436 - RNA, 100 nt, synthetic construct; identical to SEQ ID NO: 30434
  source 1..100: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine

SEQ ID NO: 30437 - RNA, 124 nt, synthetic construct
  source 1..124: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 121: mod_base = OTHER; note = cytidine phosphorothioate
  modified_base 122: mod_base = OTHER; note = 2'-O-methyl adenosine phosphorothioate
  modified_base 123: mod_base = OTHER; note = 2'-O-methyl guanosine phosphorothioate
  modified_base 124: mod_base = OTHER; note = 2'-O-methyl uridine
cctaatgtactgtgtgcagtgttttagagctagaaatagcaagttaaaataaggctagtccgttatcaacttgaaaaagtggcaccgagtcggtgcgccttccgagtcttccactgcacacagt

SEQ ID NO: 30438 - RNA, 133 nt, synthetic construct
  source 1..133: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 130: mod_base = OTHER; note = adenosine phosphorothioate
  modified_base 131: mod_base = OTHER; note = 2'-O-methyl cytidine phosphorothioate
  modified_base 132: mod_base = OTHER; note = 2'-O-methyl adenosine phosphorothioate
  modified_base 133: mod_base = OTHER; note = 2'-O-methyl guanosine
cctaatgtactgtgtgcagtgttttagagctagaaatagcaagttaaaataaggctagtccgttatcaacttgaaaaagtggcaccgagtcggtgcgggtggcctggccttccgagtcttccactgcacacag

SEQ ID NO: 30439 - RNA, 121 nt, synthetic construct
  source 1..121: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 118: mod_base = OTHER; note = adenosine phosphorothioate
  modified_base 119: mod_base = OTHER; note = 2'-O-methyl guanosine phosphorothioate
  modified_base 120: mod_base = OTHER; note = 2'-O-methyl uridine phosphorothioate
  modified_base 121: mod_base = OTHER; note = 2'-O-methyl adenosine
cctaatgtactgtgtgcagtgttttagagctagaaatagcaagttaaaataaggctagtccgttatcaacttgaaaaagtggcaccgagtcggtgctccgagtcttccactgcacacagta

SEQ ID NO: 30440 - RNA, 125 nt, synthetic construct
  source 1..125: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 122: mod_base = OTHER; note = adenosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
cctaatgtactgtgtgcagtgttttagagctagaaatagcaagttaaaataaggctagtccgttatcaacttgaaaaagtggcaccgagtcggtgctggccttccgagtcttccactgcacacag

SEQ ID NO: 30441 - RNA, 126 nt, synthetic construct
  source 1..126: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 123: mod_base = OTHER; note = cytidine phosphorothioate
  modified_base 124: mod_base = OTHER; note = 2'-O-methyl adenosine phosphorothioate
  modified_base 125: mod_base = OTHER; note = 2'-O-methyl guanosine phosphorothioate
  modified_base 126: mod_base = OTHER; note = 2'-O-methyl uridine
cctaatgtactgtgtgcagtgttttagagctagaaatagcaagttaaaataaggctagtccgttatcaacttgaaaaagtggcaccgagtcggtgctggccttccgagtcttccactgcacacagt

SEQ ID NO: 30442 - RNA, 125 nt, synthetic construct
  source 1..125: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 122: mod_base = OTHER; note = adenosine phosphorothioate
  modified_base 123: mod_base = OTHER; note = 2'-O-methyl guanosine phosphorothioate
  modified_base 124: mod_base = OTHER; note = 2'-O-methyl uridine phosphorothioate
  modified_base 125: mod_base = OTHER; note = 2'-O-methyl adenosine
cctaatgtactgtgtgcagtgttttagagctagaaatagcaagttaaaataaggctagtccgttatcaacttgaaaaagtggcaccgagtcggtgcgccttccgagtcttccactgcacacagta

SEQ ID NO: 30443 - RNA, 122 nt, synthetic construct
  source 1..122: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 119: mod_base = OTHER; note = cytidine phosphorothioate
  modified_base 120: mod_base = OTHER; note = 2'-O-methyl adenosine phosphorothioate
  modified_base 121: mod_base = OTHER; note = 2'-O-methyl guanosine phosphorothioate
  modified_base 122: mod_base = OTHER; note = 2'-O-methyl uridine
cctaatgtactgtgtgcagtgttttagagctagaaatagcaagttaaaataaggctagtccgttatcaacttgaaaaagtggcaccgagtcggtgccttccgagtcttccactgcacacagt

SEQ ID NO: 30444 - RNA, 123 nt, synthetic construct
  source 1..123: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 120: mod_base = OTHER; note = adenosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine
cctaatgtactgtgtgcagtgttttagagctagaaatagcaagttaaaataaggctagtccgttatcaacttgaaaaagtggcaccgagtcggtgcgccttccgagtcttccactgcacacag

SEQ ID NO: 30445 - RNA, 115 nt, synthetic construct
  source 1..115: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 112: mod_base = OTHER; note = adenosine phosphorothioate
  modified_base 113: mod_base = OTHER; note = 2'-O-methyl cytidine phosphorothioate
  modified_base 114: mod_base = OTHER; note = 2'-O-methyl adenosine phosphorothioate
  modified_base 115: mod_base = OTHER; note = 2'-O-methyl guanosine
cctaatgtactgtgtgcagtgttttagagctagaaatagcaagttaaaataaggctagtccgttatcaacttgaaaaagtggcaccgagtcggtgcagtcttccactgcacacag

SEQ ID NO: 30446 - RNA, 121 nt, synthetic construct
  source 1..121: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 118: mod_base = OTHER; note = adenosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
cctaatgtactgtgtgcagtgttttagagctagaaatagcaagttaaaataaggctagtccgttatcaacttgaaaaagtggcaccgagtcggtgccttccgagtcttccactgcacacag

SEQ ID NO: 30447 - RNA, 127 nt, synthetic construct
  source 1..127: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 124: mod_base = OTHER; note = adenosine phosphorothioate
  modified_base 125: mod_base = OTHER; note = 2'-O-methyl guanosine phosphorothioate
  modified_base 126: mod_base = OTHER; note = 2'-O-methyl uridine phosphorothioate
  modified_base 127: mod_base = OTHER; note = 2'-O-methyl adenosine
cctaatgtactgtgtgcagtgttttagagctagaaatagcaagttaaaataaggctagtccgttatcaacttgaaaaagtggcaccgagtcggtgctggccttccgagtcttccactgcacacagta

SEQ ID NO: 30448 - RNA, 119 nt, synthetic construct
  source 1..119: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 116: mod_base = OTHER; note = adenosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
cctaatgtactgtgtgcagtgttttagagctagaaatagcaagttaaaataaggctagtccgttatcaacttgaaaaagtggcaccgagtcggtgctccgagtcttccactgcacacag

SEQ ID NO: 30449 - RNA, 120 nt, synthetic construct
  source 1..120: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 117: mod_base = OTHER; note = cytidine phosphorothioate
  modified_base 118: mod_base = OTHER; note = 2'-O-methyl adenosine phosphorothioate
  modified_base 119: mod_base = OTHER; note = 2'-O-methyl guanosine phosphorothioate
  modified_base 120: mod_base = OTHER; note = 2'-O-methyl uridine
cctaatgtactgtgtgcagtgttttagagctagaaatagcaagttaaaataaggctagtccgttatcaacttgaaaaagtggcaccgagtcggtgctccgagtcttccactgcacacagt

SEQ ID NO: 30450 - RNA, 119 nt, synthetic construct
  source 1..119: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 116: mod_base = OTHER; note = adenosine phosphorothioate
  modified_base 117: mod_base = OTHER; note = 2'-O-methyl guanosine phosphorothioate
  modified_base 118: mod_base = OTHER; note = 2'-O-methyl uridine phosphorothioate
  modified_base 119: mod_base = OTHER; note = 2'-O-methyl adenosine
cctaatgtactgtgtgcagtgttttagagctagaaatagcaagttaaaataaggctagtccgttatcaacttgaaaaagtggcaccgagtcggtgccgagtcttccactgcacacagta

SEQ ID NO: 30451 - RNA, 118 nt, synthetic construct
  source 1..118: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 115: mod_base = OTHER; note = cytidine phosphorothioate
  modified_base 116: mod_base = OTHER; note = 2'-O-methyl adenosine phosphorothioate
  modified_base 117: mod_base = OTHER; note = 2'-O-methyl guanosine phosphorothioate
  modified_base 118: mod_base = OTHER; note = 2'-O-methyl uridine
cctaatgtactgtgtgcagtgttttagagctagaaatagcaagttaaaataaggctagtccgttatcaacttgaaaaagtggcaccgagtcggtgccgagtcttccactgcacacagt

SEQ ID NO: 30452 - RNA, 125 nt, synthetic construct
  source 1..125: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 122: mod_base = OTHER; note = adenosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl uridine
cctaatgtactgtgtgcagtgttttagagctagaaatagcaagttaaaataaggctagtccgttatcaacttgaaaaagtggcaccgagtcggtgcttccgagtcttccactgcacacagtacat

SEQ ID NO: 30453 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 120: mod_base = OTHER; note = adenosine phosphorothioate
  modified_base 121: mod_base = OTHER; note = 2'-O-methyl guanosine phosphorothioate
  modified_base 122: mod_base = OTHER; note = 2'-O-methyl uridine phosphorothioate
  modified_base 123: mod_base = OTHER; note = 2'-O-methyl adenosine
gcctaatgtactgtgtgcaggttttagagctagaaatagcaagttaaaataaggctagtccgttatcaacttgaaaaagtggcaccgagtcggtgccttccgagtcttccactgcacacagta

SEQ ID NO: 30454 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 122: mod_base = OTHER; note = adenosine phosphorothioate
  modified_base 123: mod_base = OTHER; note = 2'-O-methyl guanosine phosphorothioate
  modified_base 124: mod_base = OTHER; note = 2'-O-methyl uridine phosphorothioate
  modified_base 125: mod_base = OTHER; note = 2'-O-methyl adenosine
gcctaatgtactgtgtgcaggttttagagctagaaatagcaagttaaaataaggctagtccgttatcaacttgaaaaagtggcaccgagtcggtgcgccttccgagtcttccactgcacacagta

SEQ ID NO: 30455 - RNA, 119 nt, synthetic construct
  source 1..119: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 116: mod_base = OTHER; note = adenosine phosphorothioate
  modified_base 117: mod_base = OTHER; note = 2'-O-methyl guanosine phosphorothioate
  modified_base 118: mod_base = OTHER; note = 2'-O-methyl uridine phosphorothioate
  modified_base 119: mod_base = OTHER; note = 2'-O-methyl adenosine
gcctaatgtactgtgtgcaggttttagagctagaaatagcaagttaaaataaggctagtccgttatcaacttgaaaaagtggcaccgagtcggtgccgagtcttccactgcacacagta

SEQ ID NO: 30456 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 125: mod_base = OTHER; note = cytidine phosphorothioate
  modified_base 126: mod_base = OTHER; note = 2'-O-methyl adenosine phosphorothioate
  modified_base 127: mod_base = OTHER; note = 2'-O-methyl uridine phosphorothioate
  modified_base 128: mod_base = OTHER; note = 2'-O-methyl uridine
gcctaatgtactgtgtgcaggttttagagctagaaatagcaagttaaaataaggctagtccgttatcaacttgaaaaagtggcaccgagtcggtgcccttccgagtcttccactgcacacagtacatt

SEQ ID NO: 30457 - RNA, 124 nt, synthetic construct; identical to SEQ ID NO: 30437
  source 1..124: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl adenosine phosphorothioate
  modified_base 123: mod_base = OTHER; note = 2'-O-methyl guanosine phosphorothioate
  modified_base 124: mod_base = OTHER; note = 2'-O-methyl uridine

SEQ ID NO: 30458 - RNA, 133 nt, synthetic construct; identical to SEQ ID NO: 30438
  source 1..133: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 130: mod_base = OTHER; note = adenosine phosphorothioate
  modified_base 131: mod_base = OTHER; note = 2'-O-methyl cytidine phosphorothioate
  modified_base 132: mod_base = OTHER; note = 2'-O-methyl adenosine phosphorothioate
  modified_base 133: mod_base = OTHER; note = 2'-O-methyl guanosine

SEQ ID NO: 30459 - RNA, 121 nt, synthetic construct; identical to SEQ ID NO: 30439
  source 1..121: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = adenosine phosphorothioate
  modified_base 119: mod_base = OTHER; note = 2'-O-methyl guanosine phosphorothioate
  modified_base 120: mod_base = OTHER; note = 2'-O-methyl uridine phosphorothioate
  modified_base 121: mod_base = OTHER; note = 2'-O-methyl adenosine

SEQ ID NO: 30460 - RNA, 125 nt, synthetic construct; identical to SEQ ID NO: 30440
  source 1..125: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = adenosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine

SEQ ID NO: 30461 - RNA, 126 nt, synthetic construct; identical to SEQ ID NO: 30441
  source 1..126: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl adenosine phosphorothioate
  modified_base 125: mod_base = OTHER; note = 2'-O-methyl guanosine phosphorothioate
  modified_base 126: mod_base = OTHER; note = 2'-O-methyl uridine

SEQ ID NO: 30462 - RNA, 125 nt, synthetic construct; identical to SEQ ID NO: 30442
  source 1..125: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = adenosine phosphorothioate
  modified_base 123: mod_base = OTHER; note = 2'-O-methyl guanosine phosphorothioate
  modified_base 124: mod_base = OTHER; note = 2'-O-methyl uridine phosphorothioate
  modified_base 125: mod_base = OTHER; note = 2'-O-methyl adenosine

SEQ ID NO: 30463 - RNA, 122 nt, synthetic construct; identical to SEQ ID NO: 30443
  source 1..122: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl adenosine phosphorothioate
  modified_base 121: mod_base = OTHER; note = 2'-O-methyl guanosine phosphorothioate
  modified_base 122: mod_base = OTHER; note = 2'-O-methyl uridine

SEQ ID NO: 30464 - RNA, 123 nt, synthetic construct; identical to SEQ ID NO: 30444
  source 1..123: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = adenosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine

SEQ ID NO: 30465 - RNA, 115 nt, synthetic construct; identical to SEQ ID NO: 30445
  source 1..115: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = adenosine phosphorothioate
  modified_base 113: mod_base = OTHER; note = 2'-O-methyl cytidine phosphorothioate
  modified_base 114: mod_base = OTHER; note = 2'-O-methyl adenosine phosphorothioate
  modified_base 115: mod_base = OTHER; note = 2'-O-methyl guanosine

SEQ ID NO: 30466 - RNA, 121 nt, synthetic construct; identical to SEQ ID NO: 30446
  source 1..121: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = adenosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine

SEQ ID NO: 30467 - RNA, 127 nt, synthetic construct; identical to SEQ ID NO: 30447
  source 1..127: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = adenosine phosphorothioate
  modified_base 125: mod_base = OTHER; note = 2'-O-methyl guanosine phosphorothioate
  modified_base 126: mod_base = OTHER; note = 2'-O-methyl uridine phosphorothioate
  modified_base 127: mod_base = OTHER; note = 2'-O-methyl adenosine

SEQ ID NO: 30468 - RNA, 119 nt, synthetic construct; identical to SEQ ID NO: 30448
  source 1..119: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = adenosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine

SEQ ID NO: 30469 - RNA, 120 nt, synthetic construct; identical to SEQ ID NO: 30449
  source 1..120: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = cytidine phosphorothioate
  modified_base 118: mod_base = OTHER; note = 2'-O-methyl adenosine phosphorothioate
  modified_base 119: mod_base = OTHER; note = 2'-O-methyl guanosine phosphorothioate
  modified_base 120: mod_base = OTHER; note = 2'-O-methyl uridine

SEQ ID NO: 30470 - RNA, 119 nt, synthetic construct; identical to SEQ ID NO: 30450
  source 1..119: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = adenosine phosphorothioate
  modified_base 117: mod_base = OTHER; note = 2'-O-methyl guanosine phosphorothioate
  modified_base 118: mod_base = OTHER; note = 2'-O-methyl uridine phosphorothioate
  modified_base 119: mod_base = OTHER; note = 2'-O-methyl adenosine

SEQ ID NO: 30471 - RNA, 118 nt, synthetic construct; identical to SEQ ID NO: 30451
  source 1..118: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = cytidine phosphorothioate
  modified_base 116: mod_base = OTHER; note = 2'-O-methyl adenosine phosphorothioate
  modified_base 117: mod_base = OTHER; note = 2'-O-methyl guanosine phosphorothioate
  modified_base 118: mod_base = OTHER; note = 2'-O-methyl uridine

SEQ ID NO: 30472 - RNA, 125 nt, synthetic construct; identical to SEQ ID NO: 30452
  source 1..125: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = adenosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl uridine

SEQ ID NO: 30473 - RNA, 123 nt, synthetic construct; identical to SEQ ID NO: 30453
  source 1..123: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = adenosine phosphorothioate
  modified_base 121: mod_base = OTHER; note = 2'-O-methyl guanosine phosphorothioate
  modified_base 122: mod_base = OTHER; note = 2'-O-methyl uridine phosphorothioate
  modified_base 123: mod_base = OTHER; note = 2'-O-methyl adenosine

SEQ ID NO: 30474 - RNA, 125 nt, synthetic construct; identical to SEQ ID NO: 30454
  source 1..125: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = adenosine phosphorothioate
  modified_base 123: mod_base = OTHER; note = 2'-O-methyl guanosine phosphorothioate
  modified_base 124: mod_base = OTHER; note = 2'-O-methyl uridine phosphorothioate
  modified_base 125: mod_base = OTHER; note = 2'-O-methyl adenosine

SEQ ID NO: 30475 - RNA, 119 nt, synthetic construct; identical to SEQ ID NO: 30455
  source 1..119: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = adenosine phosphorothioate
  modified_base 117: mod_base = OTHER; note = 2'-O-methyl guanosine phosphorothioate
  modified_base 118: mod_base = OTHER; note = 2'-O-methyl uridine phosphorothioate
  modified_base 119: mod_base = OTHER; note = 2'-O-methyl adenosine

SEQ ID NO: 30476 - RNA, 128 nt, synthetic construct; identical to SEQ ID NO: 30456
  source 1..128: mol_type = other RNA
  modified_base 1: mod_base = OTHER; note = 2'-O-methyl guanosine phosphorothioate
  modified_base 2: mod_base = OTHER; note = 2'-O-methyl cytidine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl adenosine phosphorothioate
  modified_base 127: mod_base = OTHER; note = 2'-O-methyl uridine phosphorothioate
  modified_base 128: mod_base = OTHER; note = 2'-O-methyl uridine

SEQ ID NO: 30477 - protein, 2122 aa, synthetic construct; identical to SEQ ID NO: 30427

SEQ ID NO: 30478 - RNA, 100 nt, synthetic construct
  source 1..100: mol_type = other RNA
tataaaaagccttgagttttgttttagagctagaaatagcaagttaaaataaggctagtccgttatcaacttgaaaaagtggcaccgagtcggtgctttt

SEQ ID NO: 30479 - RNA, 100 nt, synthetic construct
  source 1..100: mol_type = other RNA
ctgtcgtctcgagatttcttgttttagagctagaaatagcaagttaaaataaggctagtccgttatcaacttgaaaaagtggcaccgagtcggtgctttt

SEQ ID NO: 30480 - protein, 2121 aa, synthetic construct
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGAEAAAKEAAAKEAAAKEAAAKALEAEAAAKEAAAKEAAAKEAAAKAGGTAPLEEEYRLFLEAPIQNVTLLEQWKREIPKVWAEINPPGLASTQAPIHVQLLSTALPVRVRQYPITLEAKRSLRETIRKFRAAGILRPVHSPWNTPLLPVRKSGTSEYRMVQDLREVNKRVETIHPTVPNPYTLLSLLPPDRIWYSVLDLKDAFFCIPLAPESQLIFAFEWADAEEGESGQLTWTRLPQGFKNSPTLFNEALNRDLQGFRLDHPSVSLLQYVDDLLIAADTQAACLSATRDLLMTLAELGYRVSGKKAQLCQEEVTYLGFKIHKGSRSLSNSRTQAILQIPVPKTKRQVREFLGKIGYCRLFIPGFAELAQPLYAATRPGNDPLVWGEKEEEAFQSLKLALTQPPALALPSLDKPFQLFVEETSGAAKGVLTQALGPWKRPVAYLSKRLDPVAAGWPRCLRAIAAAALLTREASKLTFGQDIEITSSHNLESLLRSPPDKWLTNARITQYQVLLLDPPRVRFKQTAALNPATLLPETDDTLPIHHCLDTLDSLTSTRPDLTDQPLAQAEATLFTDGSSYIRDGKRYAGAAVVTLDSVIWAEPLPIGTSAQKAELIALTKALEWSKDKSVNIYTDSRYAFATLHVHGMIYRERGWLTAGGKAIKNAPEILALLTAVWLPKRVAVMHCKGHQKDDAPTSTGNRRADEVAREVAIRPLSTQATISAGKRTADGSEFEKRTADGSEFESPKKKAKVE

SEQ ID NO: 30481 - RNA, 20 nt, synthetic construct
  source 1..20: mol_type = other RNA
gggtcatagcgaactgagaa

SEQ ID NO: 30482 - RNA, 20 nt, synthetic construct
  source 1..20: mol_type = other RNA
tagcgaactgagaagggccg

SEQ ID NO: 30483 - RNA, 20 nt, synthetic construct
  source 1..20: mol_type = other RNA
agcgaactgagaagggccga

SEQ ID NO: 30484 - RNA, 20 nt, synthetic construct
  source 1..20: mol_type = other RNA
actttgctgccacaatccct

SEQ ID NO: 30485 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcaatacctcggcccttctcagttcgct

SEQ ID NO: 30486 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcacaatacctcggcccttctcagttcgct

SEQ ID NO: 30487 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcaatacctcggcccttctcagttcgc

SEQ ID NO: 30488 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcaatacctcggcccttctcagttcgct

SEQ ID NO: 30489 - RNA, 115 nt, synthetic construct
  source 1..115: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = cytidine phosphorothioate
  modified_base 113: mod_base = OTHER; note = 2'-O-methyl uridine phosphorothioate
  modified_base 114: mod_base = OTHER; note = 2'-O-methyl cytidine phosphorothioate
  modified_base 115: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcaatacctcggcccttctca

SEQ ID NO: 30490 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl adenosine phosphorothioate
  modified_base 116: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcaatacctcggcccttctcag

SEQ ID NO: 30491 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl adenosine phosphorothioate
  modified_base 116: mod_base = OTHER; note = 2'-O-methyl guanosine phosphorothioate
  modified_base 117: mod_base = OTHER; note = 2'-O-methyl uridine
tagcgaactgagaagggccagttttagagctagaaatagcaagttaaaataaggctagtccgttatcaacttgaaaaagtggcaccgagtcggtgcaatacctcggcccttctcagt

SEQ ID NO: 30492 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcacaatacctcggcccttctcag

SEQ ID NO: 30493 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl adenosine phosphorothioate
  modified_base 118: mod_base = OTHER; note = 2'-O-methyl guanosine phosphorothioate
  modified_base 119: mod_base = OTHER; note = 2'-O-methyl uridine
tagcgaactgagaagggccagttttagagctagaaatagcaagttaaaataaggctagtccgttatcaacttgaaaaagtggcaccgagtcggtgcacaatacctcggcccttctcagt

SEQ ID NO: 30494 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcgctgccacaatacctcggcccttctc

SEQ ID NO: 30495 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl uridine phosphorothioate
  modified_base 123: mod_base = OTHER; note = 2'-O-methyl adenosine phosphorothioate
  modified_base 124: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaatacctcggcccttctcagttcgctac

SEQ ID NO: 30496 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaatacctcggcccttctcagttcgc

SEQ ID NO: 30497 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcacaatacctcggcccttctcagttcgc

SEQ ID NO: 30498 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctgccacaatacctcggcccttctcagttcgc

SEQ ID NO: 30499 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaagggccgaggtattgtggcag

SEQ ID NO: 30500 - RNA, 116 nt, synthetic construct
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = guanosine phosphorothioate
  modified_base 114: mod_base = OTHER; note = 2'-O-methyl cytidine phosphorothioate
  modified_base 115: mod_base = OTHER; note = 2'-O-methyl adenosine phosphorothioate
  modified_base 116: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgggccgaggtattgtggcag

SEQ ID NO: 30501 - RNA, 100 nt, synthetic construct
  source 1..100: mol_type = other RNA
  modified_base 1: mod_base = OTHER; note = 2'-O-methyl guanosine phosphorothioate
  modified_base 2: mod_base = OTHER; note = 2'-O-methyl uridine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
gtgcccttcactcaagcctggttttagagctagaaatagcaagttaaaataaggctagtccgttatcaacttgaaaaagtggcaccgagtcggtgctttt

SEQ ID NO: 30502 - RNA, 100 nt, synthetic construct
  source 1..100: mol_type = other RNA
  modified_base 1: mod_base = OTHER; note = 2'-O-methyl uridine phosphorothioate
  modified_base 2: mod_base = OTHER; note = 2'-O-methyl uridine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
ttcactcaagcctgtggtttgttttagagctagaaatagcaagttaaaataaggctagtccgttatcaacttgaaaaagtggcaccgagtcggtgctttt

SEQ ID NO: 30503 - RNA, 100 nt, synthetic construct
  source 1..100: mol_type = other RNA
  modified_base 1: mod_base = OTHER; note = 2'-O-methyl guanosine phosphorothioate
  modified_base 2: mod_base = OTHER; note = 2'-O-methyl uridine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
gtccaagacctcaatcctttgttttagagctagaaatagcaagttaaaataaggctagtccgttatcaacttgaaaaagtggcaccgagtcggtgctttt

SEQ ID NO: 30504 - RNA, 100 nt, synthetic construct
  source 1..100: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
tagcgaactgagaagggccagttttagagctagaaatagcaagttaaaataaggctagtccgttatcaacttgaaaaagtggcaccgagtcggtgctttt

SEQ ID NO: 30505 - RNA, 100 nt, synthetic construct
  source 1..100: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl adenosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
tgagaagggccgaggtattggttttagagctagaaatagcaagttaaaataaggctagtccgttatcaacttgaaaaagtggcaccgagtcggtgctttt

SEQ ID NO: 30506 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcacaataccttggcccttctcagttcgc

SEQ ID NO: 30507 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcaataccttggcccttctcagttcgc

SEQ ID NO: 30508 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcaataccttggcccttctcagttcgct

SEQ ID NO: 30509 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcacaataccttggcccttctcagttcgct

SEQ ID NO: 30510 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
gggtcgtagcgaactgagaagttttagagctagaaatagcaagttaaaataaggctagtccgttatcaacttgaaaaagtggcaccgagtcggtgcacaataccttggcccttctcagttcgcta

SEQ ID NO: 30511 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcacaataccttggcccttctcagttcg

SEQ ID NO: 30512 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcccacaataccttggcccttctcagttcgc

SEQ ID NO: 30513 - RNA, 119 nt, synthetic construct
  source 1..119: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl cytidine phosphorothioate
  modified_base 118: mod_base = OTHER; note = 2'-O-methyl guanosine phosphorothioate
  modified_base 119: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctaccttggcccttctcagttcgc

SEQ ID NO: 30514 - RNA, 129 nt, synthetic construct
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcgctgccacaataccttggcccttctcagttcgc

SEQ ID NO: 30515 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctgccacaataccttggcccttctcagttcgc

SEQ ID NO: 30516 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaataccttggcccttctcagttcgc

SEQ ID NO: 30517 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaataccttggcccttctcagttcgc

SEQ ID NO: 30518 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcaataccttggcccttctcagttcgct

SEQ ID NO: 30519 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcaataccttggcccttctcagttcgcta

SEQ ID NO: 30520 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcacaataccttggcccttctcagttcgct

SEQ ID NO: 30521 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgctgccacaataccttggcccttctcagttcgc

SEQ ID NO: 30522 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcacaataccttggcccttctcagttcgcta

SEQ ID NO: 30523 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl adenosine phosphorothioate
  modified_base 124: mod_base = OTHER; note = 2'-O-methyl cytidine phosphorothioate
  modified_base 125: mod_base = OTHER; note = 2'-O-methyl guanosine
tgggtcgtagcgaactgagagttttagagctagaaatagcaagttaaaataaggctagtccgttatcaacttgaaaaagtggcaccgagtcggtgcaataccttggcccttctcagttcgctacg

SEQ ID NO: 30524 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl uridine phosphorothioate
  modified_base 123: mod_base = OTHER; note = 2'-O-methyl adenosine phosphorothioate
  modified_base 124: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaataccttggcccttctcagttcgctac

SEQ ID NO: 30525 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl uridine phosphorothioate
  modified_base 125: mod_base = OTHER; note = 2'-O-methyl adenosine phosphorothioate
  modified_base 126: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaataccttggcccttctcagttcgctac

SEQ ID NO: 30526 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl adenosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgggccaaggtattgtggcagc

SEQ ID NO: 30527 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
actttgctgccacaatacctgttttagagctagaaatagcaagttaaaataaggctagtccgttatcaacttgaaaaagtggcaccgagtcggtgcactgagaagggccaaggtattgtggcag

SEQ ID NO: 30528 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl guanosine phosphorothioate
  modified_base 117: mod_base = OTHER; note = 2'-O-methyl guanosine phosphorothioate
  modified_base 118: mod_base = OTHER; note = 2'-O-methyl cytidine
actttgctgccacaatacctgttttagagctagaaatagcaagttaaaataaggctagtccgttatcaacttgaaaaagtggcaccgagtcggtgcagaagggccaaggtattgtggc

SEQ ID NO: 30529 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaagggccaaggtattgtggcag

SEQ ID NO: 30530 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
actttgctgccacaatacctgttttagagctagaaatagcaagttaaaataaggctagtccgttatcaacttgaaaaagtggcaccgagtcggtgctgagaagggccaaggtattgtggcag

SEQ ID NO: 30531 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl guanosine phosphorothioate
  modified_base 118: mod_base = OTHER; note = 2'-O-methyl cytidine phosphorothioate
  modified_base 119: mod_base = OTHER; note = 2'-O-methyl adenosine
actttgctgccacaatacctgttttagagctagaaatagcaagttaaaataaggctagtccgttatcaacttgaaaaagtggcaccgagtcggtgcagaagggccaaggtattgtggca

SEQ ID NO: 30532 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = adenosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaagggccaaggtattgtggcagca

SEQ ID NO: 30533 - RNA, 116 nt, synthetic construct
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = guanosine phosphorothioate
  modified_base 114: mod_base = OTHER; note = 2'-O-methyl cytidine phosphorothioate
  modified_base 115: mod_base = OTHER; note = 2'-O-methyl adenosine phosphorothioate
  modified_base 116: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgggccaaggtattgtggcag

SEQ ID NO: 30534 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = adenosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcagaagggccaaggtattgtggcagca

SEQ ID NO: 30535 - RNA, 116 nt, synthetic construct
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl guanosine phosphorothioate
  modified_base 115: mod_base = OTHER; note = 2'-O-methyl guanosine phosphorothioate
  modified_base 116: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaagggccaaggtattgtggc

SEQ ID NO: 30536 - RNA, 118 nt, synthetic construct; identical to SEQ ID NO: 30492
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine

SEQ ID NO: 30537 - RNA, 117 nt, synthetic construct; identical to SEQ ID NO: 30491
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl adenosine phosphorothioate
  modified_base 116: mod_base = OTHER; note = 2'-O-methyl guanosine phosphorothioate
  modified_base 117: mod_base = OTHER; note = 2'-O-methyl uridine

SEQ ID NO: 30538 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = adenosine phosphorothioate
  modified_base 118: mod_base = OTHER; note = 2'-O-methyl guanosine phosphorothioate
  modified_base 119: mod_base = OTHER; note = 2'-O-methyl uridine phosphorothioate
  modified_base 120: mod_base = OTHER; note = 2'-O-methyl uridine
tagcgaactgagaagggccagttttagagctagaaatagcaagttaaaataaggctagtccgttatcaacttgaaaaagtggcaccgagtcggtgcacaatacctcggcccttctcagtt

SEQ ID NO: 30539 - RNA, 116 nt, synthetic construct; identical to SEQ ID NO: 30490
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl adenosine phosphorothioate
  modified_base 116: mod_base = OTHER; note = 2'-O-methyl guanosine

SEQ ID NO: 30540 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcgctgccacaatacctcggcccttctcag

SEQ ID NO: 30541 - RNA, 119 nt, synthetic construct; identical to SEQ ID NO: 30493
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl adenosine phosphorothioate
  modified_base 118: mod_base = OTHER; note = 2'-O-methyl guanosine phosphorothioate
  modified_base 119: mod_base = OTHER; note = 2'-O-methyl uridine

SEQ ID NO: 30542 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine
tagcgaactgagaagggccagttttagagctagaaatagcaagttaaaataaggctagtccgttatcaacttgaaaaagtggcaccgagtcggtgctgccacaatacctcggcccttctca

SEQ ID NO: 30543 - RNA, 122 nt, synthetic construct; identical to SEQ ID NO: 30494
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine

SEQ ID NO: 30544 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl adenosine phosphorothioate
  modified_base 126: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcttgctgccacaatacctcggcccttctcag

SEQ ID NO: 30545 - RNA, 115 nt, synthetic construct; identical to SEQ ID NO: 30489
  source 1..115: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = cytidine phosphorothioate
  modified_base 113: mod_base = OTHER; note = 2'-O-methyl uridine phosphorothioate
  modified_base 114: mod_base = OTHER; note = 2'-O-methyl cytidine phosphorothioate
  modified_base 115: mod_base = OTHER; note = 2'-O-methyl adenosine

SEQ ID NO: 30546 - RNA, 123 nt, synthetic construct; identical to SEQ ID NO: 30497
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine

SEQ ID NO: 30547 - RNA, 121 nt, synthetic construct; identical to SEQ ID NO: 30487
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine

SEQ ID NO: 30548 - RNA, 122 nt, synthetic construct; identical to SEQ ID NO: 30488
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine

SEQ ID NO: 30549 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcacaatacctcggcccttctcagttcgct

SEQ ID NO: 30550 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
gggtcgtagcgaactgagaagttttagagctagaaatagcaagttaaaataaggctagtccgttatcaacttgaaaaagtggcaccgagtcggtgcacaatacctcggcccttctcagttcgcta

SEQ ID NO: 30551 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcacaatacctcggcccttctcagttcg

SEQ ID NO: 30552 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcccacaatacctcggcccttctcagttcgc

SEQ ID NO: 30553 - RNA, 119 nt, synthetic construct
  source 1..119: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl cytidine phosphorothioate
  modified_base 118: mod_base = OTHER; note = 2'-O-methyl guanosine phosphorothioate
  modified_base 119: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctacctcggcccttctcagttcgc

SEQ ID NO: 30554 - RNA, 129 nt, synthetic construct
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcgctgccacaatacctcggcccttctcagttcgc

SEQ ID NO: 30555 - RNA, 127 nt, synthetic construct; identical to SEQ ID NO: 30498
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine

SEQ ID NO: 30556 - RNA, 121 nt, synthetic construct; identical to SEQ ID NO: 30496
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine

SEQ ID NO: 30557 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaatacctcggcccttctcagttcgc

SEQ ID NO: 30558 - RNA, 122 nt, synthetic construct; identical to SEQ ID NO: 30485
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine

SEQ ID NO: 30559 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcaatacctcggcccttctcagttcgcta

SEQ ID NO: 30560 - RNA, 124 nt, synthetic construct; identical to SEQ ID NO: 30486
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine

SEQ ID NO: 30561 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgctgccacaatacctcggcccttctcagttcgc

SEQ ID NO: 30562 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcacaatacctcggcccttctcagttcgcta

SEQ ID NO: 30563 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl adenosine phosphorothioate
  modified_base 124: mod_base = OTHER; note = 2'-O-methyl cytidine phosphorothioate
  modified_base 125: mod_base = OTHER; note = 2'-O-methyl guanosine
tgggtcgtagcgaactgagagttttagagctagaaatagcaagttaaaataaggctagtccgttatcaacttgaaaaagtggcaccgagtcggtgcaatacctcggcccttctcagttcgctacg

SEQ ID NO: 30564 - RNA, 124 nt, synthetic construct; identical to SEQ ID NO: 30495
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl uridine phosphorothioate
  modified_base 123: mod_base = OTHER; note = 2'-O-methyl adenosine phosphorothioate
  modified_base 124: mod_base = OTHER; note = 2'-O-methyl cytidine

SEQ ID NO: 30565 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl uridine phosphorothioate
  modified_base 125: mod_base = OTHER; note = 2'-O-methyl adenosine phosphorothioate
  modified_base 126: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaatacctcggcccttctcagttcgctac

SEQ ID NO: 30566 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl adenosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgggccgaggtattgtggcagc

SEQ ID NO: 30567 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
actttgctgccacaatacctgttttagagctagaaatagcaagttaaaataaggctagtccgttatcaacttgaaaaagtggcaccgagtcggtgcactgagaagggccgaggtattgtggcag

SEQ ID NO: 30568 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl guanosine phosphorothioate
  modified_base 117: mod_base = OTHER; note = 2'-O-methyl guanosine phosphorothioate
  modified_base 118: mod_base = OTHER; note = 2'-O-methyl cytidine
actttgctgccacaatacctgttttagagctagaaatagcaagttaaaataaggctagtccgttatcaacttgaaaaagtggcaccgagtcggtgcagaagggccgaggtattgtggc

SEQ ID NO: 30569 - RNA, 118 nt, synthetic construct; identical to SEQ ID NO: 30499
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine

SEQ ID NO: 30570 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
actttgctgccacaatacctgttttagagctagaaatagcaagttaaaataaggctagtccgttatcaacttgaaaaagtggcaccgagtcggtgctgagaagggccgaggtattgtggcag

SEQ ID NO: 30571 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl guanosine phosphorothioate
  modified_base 118: mod_base = OTHER; note = 2'-O-methyl cytidine phosphorothioate
  modified_base 119: mod_base = OTHER; note = 2'-O-methyl adenosine
actttgctgccacaatacctgttttagagctagaaatagcaagttaaaataaggctagtccgttatcaacttgaaaaagtggcaccgagtcggtgcagaagggccgaggtattgtggca

SEQ ID NO: 30572 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = adenosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaagggccgaggtattgtggcagca

SEQ ID NO: 30573 - RNA, 116 nt, synthetic construct; identical to SEQ ID NO: 30500
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = guanosine phosphorothioate
  modified_base 114: mod_base = OTHER; note = 2'-O-methyl cytidine phosphorothioate
  modified_base 115: mod_base = OTHER; note = 2'-O-methyl adenosine phosphorothioate
  modified_base 116: mod_base = OTHER; note = 2'-O-methyl guanosine

SEQ ID NO: 30574 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = adenosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcagaagggccgaggtattgtggcagca

SEQ ID NO: 30575 - RNA, 116 nt, synthetic construct
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl guanosine phosphorothioate
  modified_base 115: mod_base = OTHER; note = 2'-O-methyl guanosine phosphorothioate
  modified_base 116: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaagggccgaggtattgtggc

SEQ ID NO: 30576 - RNA, 100 nt, synthetic construct; identical to SEQ ID NO: 30501
  source 1..100: mol_type = other RNA
  modified_base 1: mod_base = OTHER; note = 2'-O-methyl guanosine phosphorothioate
  modified_base 2: mod_base = OTHER; note = 2'-O-methyl uridine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine

SEQ ID NO: 30577 - RNA, 100 nt, synthetic construct; identical to SEQ ID NO: 30502
  source 1..100: mol_type = other RNA
  modified_base 1: mod_base = OTHER; note = 2'-O-methyl uridine phosphorothioate
  modified_base 2: mod_base = OTHER; note = 2'-O-methyl uridine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine

SEQ ID NO: 30578 - RNA, 100 nt, synthetic construct; identical to SEQ ID NO: 30503
  source 1..100: mol_type = other RNA
  modified_base 1: mod_base = OTHER; note = 2'-O-methyl guanosine phosphorothioate
  modified_base 2: mod_base = OTHER; note = 2'-O-methyl uridine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine

SEQ ID NO: 30579 - RNA, 100 nt, synthetic construct
  source 1..100: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
tgtccaagacctcaatccttgttttagagctagaaatagcaagttaaaataaggctagtccgttatcaacttgaaaaagtggcaccgagtcggtgctttt

SEQ ID NO: 30580 - RNA, 100 nt, synthetic construct
  source 1..100: mol_type = other RNA
  modified_base 1: mod_base = OTHER; note = 2'-O-methyl cytidine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 97: mod_base = OTHER; note = 2'-O-methyl uridine phosphorothioate
  modified_base 98: mod_base = OTHER; note = 2'-O-methyl uridine phosphorothioate
  modified_base 99: mod_base = OTHER; note = 2'-O-methyl uridine phosphorothioate
  modified_base 100: mod_base = OTHER; note = 2'-O-methyl uridine
cctcaatcctttgggtgtatgttttagagctagaaatagcaagttaaaataaggctagtccgttatcaacttgaaaaagtggcaccgagtcggtgctttt

SEQ ID NO: 30581 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcatagcgaactgagaagttttagagctagaaatagcaagttaaaataaggctagtccgttatcaacttgaaaaagtggcaccgagtcggtgcaatccctaggcccttttcagttcgc

SEQ ID NO: 30582 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcatagcgaactgagaagttttagagctagaaatagcaagttaaaataaggctagtccgttatcaacttgaaaaagtggcaccgagtcggtgcacaatccctaggcccttttcagttcgc

SEQ ID NO: 30583 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcatagcgaactgagaagttttagagctagaaatagcaagttaaaataaggctagtccgttatcaacttgaaaaagtggcaccgagtcggtgcaatccctaggcccttttcagttcgct

SEQ ID NO: 30584 - RNA, 119 nt, synthetic construct
  source 1..119: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl cytidine phosphorothioate
  modified_base 118: mod_base = OTHER; note = 2'-O-methyl guanosine phosphorothioate
  modified_base 119: mod_base = OTHER; note = 2'-O-methyl cytidine
gggtcatagcgaactgagaagttttagagctagaaatagcaagttaaaataaggctagtccgttatcaacttgaaaaagtggcaccgagtcggtgctccctaggcccttttcagttcgc

SEQ ID NO: 30585 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
gggtcatagcgaactgagaagttttagagctagaaatagcaagttaaaataaggctagtccgttatcaacttgaaaaagtggcaccgagtcggtgcacaatccctaggcccttttcagttcgcta

SEQ ID NO: 30586 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
gggtcatagcgaactgagaagttttagagctagaaatagcaagttaaaataaggctagtccgttatcaacttgaaaaagtggcaccgagtcggtgcaatccctaggcccttttcagttcgcta

SEQ ID NO: 30587 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcatagcgaactgagaagttttagagctagaaatagcaagttaaaataaggctagtccgttatcaacttgaaaaagtggcaccgagtcggtgcacaatccctaggcccttttcagttcgct

SEQ ID NO: 30588 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = adenosine phosphorothioate
  modified_base 124: mod_base = OTHER; note = 2'-O-methyl uridine phosphorothioate
  modified_base 125: mod_base = OTHER; note = 2'-O-methyl guanosine phosphorothioate
  modified_base 126: mod_base = OTHER; note = 2'-O-methyl adenosine
gggtcatagcgaactgagaagttttagagctagaaatagcaagttaaaataaggctagtccgttatcaacttgaaaaagtggcaccgagtcggtgcaatccctaggcccttttcagttcgctatga

SEQ ID NO: 30589 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcatagcgaactgagaagttttagagctagaaatagcaagttaaaataaggctagtccgttatcaacttgaaaaagtggcaccgagtcggtgctgccacaatccctaggcccttttcagttcgc

SEQ ID NO: 30590 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl adenosine phosphorothioate
  modified_base 124: mod_base = OTHER; note = 2'-O-methyl uridine phosphorothioate
  modified_base 125: mod_base = OTHER; note = 2'-O-methyl guanosine
gggtcatagcgaactgagaagttttagagctagaaatagcaagttaaaataaggctagtccgttatcaacttgaaaaagtggcaccgagtcggtgcaatccctaggcccttttcagttcgctatg

SEQ ID NO: 30591 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl guanosine
gggtcatagcgaactgagaagttttagagctagaaatagcaagttaaaataaggctagtccgttatcaacttgaaaaagtggcaccgagtcggtgcgctgccacaatccctaggcccttttcagttcg

SEQ ID NO: 30592 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = adenosine phosphorothioate
  modified_base 118: mod_base = OTHER; note = 2'-O-methyl guanosine phosphorothioate
  modified_base 119: mod_base = OTHER; note = 2'-O-methyl uridine phosphorothioate
  modified_base 120: mod_base = OTHER; note = 2'-O-methyl uridine
tagcgaactgagaagggccggttttagagctagaaatagcaagttaaaataaggctagtccgttatcaacttgaaaaagtggcaccgagtcggtgcacaatccctagacccttctcagtt

SEQ ID NO: 30593 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
tagcgaactgagaagggccggttttagagctagaaatagcaagttaaaataaggctagtccgttatcaacttgaaaaagtggcaccgagtcggtgcgctgccacaatccctagacccttctcag

SEQ ID NO: 30594 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
tagcgaactgagaagggccggttttagagctagaaatagcaagttaaaataaggctagtccgttatcaacttgaaaaagtggcaccgagtcggtgcacaatccctagacccttctcag

SEQ ID NO: 30595 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl adenosine phosphorothioate
  modified_base 118: mod_base = OTHER; note = 2'-O-methyl guanosine phosphorothioate
  modified_base 119: mod_base = OTHER; note = 2'-O-methyl uridine
tagcgaactgagaagggccggttttagagctagaaatagcaagttaaaataaggctagtccgttatcaacttgaaaaagtggcaccgagtcggtgcacaatccctagacccttctcagt

SEQ ID NO: 30596 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl adenosine phosphorothioate
  modified_base 124: mod_base = OTHER; note = 2'-O-methyl guanosine phosphorothioate
  modified_base 125: mod_base = OTHER; note = 2'-O-methyl uridine
tagcgaactgagaagggccggttttagagctagaaatagcaagttaaaataaggctagtccgttatcaacttgaaaaagtggcaccgagtcggtgcgctgccacaatccctagacccttctcagt

SEQ ID NO: 30597 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl adenosine phosphorothioate
  modified_base 116: mod_base = OTHER; note = 2'-O-methyl guanosine phosphorothioate
  modified_base 117: mod_base = OTHER; note = 2'-O-methyl uridine
tagcgaactgagaagggccggttttagagctagaaatagcaagttaaaataaggctagtccgttatcaacttgaaaaagtggcaccgagtcggtgcaatccctagacccttctcagt

SEQ ID NO: 30598 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl uridine phosphorothioate
  modified_base 118: mod_base = OTHER; note = 2'-O-methyl uridine phosphorothioate
  modified_base 119: mod_base = OTHER; note = 2'-O-methyl cytidine
tagcgaactgagaagggccggttttagagctagaaatagcaagttaaaataaggctagtccgttatcaacttgaaaaagtggcaccgagtcggtgcaatccctagacccttctcagttc

SEQ ID NO: 30599 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = adenosine phosphorothioate
  modified_base 116: mod_base = OTHER; note = 2'-O-methyl guanosine phosphorothioate
  modified_base 117: mod_base = OTHER; note = 2'-O-methyl uridine phosphorothioate
  modified_base 118: mod_base = OTHER; note = 2'-O-methyl uridine
tagcgaactgagaagggccggttttagagctagaaatagcaagttaaaataaggctagtccgttatcaacttgaaaaagtggcaccgagtcggtgcaatccctagacccttctcagtt

SEQ ID NO: 30600 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
tagcgaactgagaagggccggttttagagctagaaatagcaagttaaaataaggctagtccgttatcaacttgaaaaagtggcaccgagtcggtgctgccacaatccctagacccttctcag

SEQ ID NO: 30601 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl uridine phosphorothioate
  modified_base 116: mod_base = OTHER; note = 2'-O-methyl cytidine phosphorothioate
  modified_base 117: mod_base = OTHER; note = 2'-O-methyl adenosine
tagcgaactgagaagggccggttttagagctagaaatagcaagttaaaataaggctagtccgttatcaacttgaaaaagtggcaccgagtcggtgcacaatccctagacccttctca

SEQ ID NO: 30602 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl cytidine phosphorothioate
  modified_base 127: mod_base = OTHER; note = 2'-O-methyl adenosine phosphorothioate
  modified_base 128: mod_base = OTHER; note = 2'-O-methyl guanosine
tagcgaactgagaagggccggttttagagctagaaatagcaagttaaaataaggctagtccgttatcaacttgaaaaagtggcaccgagtcggtgcctttgctgccacaatccctagacccttctcag

SEQ ID NO: 30603 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl uridine phosphorothioate
  modified_base 126: mod_base = OTHER; note = 2'-O-methyl cytidine
tagcgaactgagaagggccggttttagagctagaaatagcaagttaaaataaggctagtccgttatcaacttgaaaaagtggcaccgagtcggtgcctttgctgccacaatccctagacccttctc

SEQ ID NO: 30604 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl uridine phosphorothioate
  modified_base 124: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcttgctgccacaatacctaggcccttctc

SEQ ID NO: 30605 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcgctgccacaatacctaggcccttctc

SEQ ID NO: 30606 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl uridine phosphorothioate
  modified_base 120: mod_base = OTHER; note = 2'-O-methyl cytidine
agcgaactgagaagggccgagttttagagctagaaatagcaagttaaaataaggctagtccgttatcaacttgaaaaagtggcaccgagtcggtgctgccacaatacctaggcccttctc

SEQ ID NO: 30607 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl uridine phosphorothioate
  modified_base 124: mod_base = OTHER; note = 2'-O-methyl cytidine phosphorothioate
  modified_base 125: mod_base = OTHER; note = 2'-O-methyl adenosine
agcgaactgagaagggccgagttttagagctagaaatagcaagttaaaataaggctagtccgttatcaacttgaaaaagtggcaccgagtcggtgcttgctgccacaatacctaggcccttctca

SEQ ID NO: 30608 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl uridine
agcgaactgagaagggccgagttttagagctagaaatagcaagttaaaataaggctagtccgttatcaacttgaaaaagtggcaccgagtcggtgctgccacaatacctaggcccttct

SEQ ID NO: 30609 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine
agcgaactgagaagggccgagttttagagctagaaatagcaagttaaaataaggctagtccgttatcaacttgaaaaagtggcaccgagtcggtgctgccacaatacctaggcccttctca

SEQ ID NO: 30610 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
agcgaactgagaagggccgagttttagagctagaaatagcaagttaaaataaggctagtccgttatcaacttgaaaaagtggcaccgagtcggtgctgccacaatacctaggcccttctcag

SEQ ID NO: 30611 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl uridine phosphorothioate
  modified_base 125: mod_base = OTHER; note = 2'-O-methyl uridine phosphorothioate
  modified_base 126: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcaactttgctgccacaatacctaggcccttc

SEQ ID NO: 30612 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = cytidine phosphorothioate
  modified_base 118: mod_base = OTHER; note = 2'-O-methyl uridine phosphorothioate
  modified_base 119: mod_base = OTHER; note = 2'-O-methyl uridine phosphorothioate
  modified_base 120: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcgctgccacaatacctaggcccttc

SEQ ID NO: 30613 - RNA, 128 nt, synthetic construct
  source 1..128: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl cytidine phosphorothioate
  modified_base 127: mod_base = OTHER; note = 2'-O-methyl uridine phosphorothioate
  modified_base 128: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcaactttgctgccacaatacctaggcccttctc

SEQ ID NO: 30614 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
agcgaactgagaagggccgagttttagagctagaaatagcaagttaaaataaggctagtccgttatcaacttgaaaaagtggcaccgagtcggtgcacaatacctaggcccttctcagttcg

SEQ ID NO: 30615 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl guanosine
agcgaactgagaagggccgagttttagagctagaaatagcaagttaaaataaggctagtccgttatcaacttgaaaaagtggcaccgagtcggtgctgccacaatacctaggcccttctcagttcg

SEQ ID NO: 30616 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = guanosine phosphorothioate
  modified_base 115: mod_base = OTHER; note = 2'-O-methyl guanosine phosphorothioate
  modified_base 116: mod_base = OTHER; note = 2'-O-methyl cytidine phosphorothioate
  modified_base 117: mod_base = OTHER; note = 2'-O-methyl adenosine
actttgctgccacaatccctgttttagagctagaaatagcaagttaaaataaggctagtccgttatcaacttgaaaaagtggcaccgagtcggtgcaagggtctagggattgtggca

SEQ ID NO: 30617 - RNA, 116 nt, synthetic construct
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl guanosine phosphorothioate
  modified_base 115: mod_base = OTHER; note = 2'-O-methyl guanosine phosphorothioate
  modified_base 116: mod_base = OTHER; note = 2'-O-methyl cytidine
actttgctgccacaatccctgttttagagctagaaatagcaagttaaaataaggctagtccgttatcaacttgaaaaagtggcaccgagtcggtgcaagggtctagggattgtggc

SEQ ID NO: 30618 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
actttgctgccacaatccctgttttagagctagaaatagcaagttaaaataaggctagtccgttatcaacttgaaaaagtggcaccgagtcggtgcaagggtctagggattgtggcag

SEQ ID NO: 30619 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl guanosine phosphorothioate
  modified_base 120: mod_base = OTHER; note = 2'-O-methyl cytidine phosphorothioate
  modified_base 121: mod_base = OTHER; note = 2'-O-methyl adenosine
actttgctgccacaatccctgttttagagctagaaatagcaagttaaaataaggctagtccgttatcaacttgaaaaagtggcaccgagtcggtgctgagaagggtctagggattgtggca

SEQ ID NO: 30620 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl guanosine phosphorothioate
  modified_base 118: mod_base = OTHER; note = 2'-O-methyl cytidine phosphorothioate
  modified_base 119: mod_base = OTHER; note = 2'-O-methyl adenosine
actttgctgccacaatccctgttttagagctagaaatagcaagttaaaataaggctagtccgttatcaacttgaaaaagtggcaccgagtcggtgcagaagggtctagggattgtggca

SEQ ID NO: 30621 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl guanosine phosphorothioate
  modified_base 121: mod_base = OTHER; note = 2'-O-methyl guanosine phosphorothioate
  modified_base 122: mod_base = OTHER; note = 2'-O-methyl cytidine
actttgctgccacaatccctgttttagagctagaaatagcaagttaaaataaggctagtccgttatcaacttgaaaaagtggcaccgagtcggtgcactgagaagggtctagggattgtggc

SEQ ID NO: 30622 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl guanosine phosphorothioate
  modified_base 119: mod_base = OTHER; note = 2'-O-methyl guanosine phosphorothioate
  modified_base 120: mod_base = OTHER; note = 2'-O-methyl cytidine
actttgctgccacaatccctgttttagagctagaaatagcaagttaaaataaggctagtccgttatcaacttgaaaaagtggcaccgagtcggtgctgagaagggtctagggattgtggc

SEQ ID NO: 30623 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl guanosine phosphorothioate
  modified_base 117: mod_base = OTHER; note = 2'-O-methyl guanosine phosphorothioate
  modified_base 118: mod_base = OTHER; note = 2'-O-methyl cytidine
actttgctgccacaatccctgttttagagctagaaatagcaagttaaaataaggctagtccgttatcaacttgaaaaagtggcaccgagtcggtgcagaagggtctagggattgtggc

SEQ ID NO: 30624 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = guanosine phosphorothioate
  modified_base 118: mod_base = OTHER; note = 2'-O-methyl cytidine phosphorothioate
  modified_base 119: mod_base = OTHER; note = 2'-O-methyl adenosine phosphorothioate
  modified_base 120: mod_base = OTHER; note = 2'-O-methyl guanosine
actttgctgccacaatccctgttttagagctagaaatagcaagttaaaataaggctagtccgttatcaacttgaaaaagtggcaccgagtcggtgcagaagggtctagggattgtggcag

SEQ ID NO: 30625 - RNA, 115 nt, synthetic construct
  source 1..115: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = guanosine phosphorothioate
  modified_base 113: mod_base = OTHER; note = 2'-O-methyl uridine phosphorothioate
  modified_base 114: mod_base = OTHER; note = 2'-O-methyl guanosine phosphorothioate
  modified_base 115: mod_base = OTHER; note = 2'-O-methyl guanosine
actttgctgccacaatccctgttttagagctagaaatagcaagttaaaataaggctagtccgttatcaacttgaaaaagtggcaccgagtcggtgcaagggtctagggattgtgg

SEQ ID NO: 30626 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl adenosine
actttgctgccacaatccctgttttagagctagaaatagcaagttaaaataaggctagtccgttatcaacttgaaaaagtggcaccgagtcggtgcaagggtctagggattgtggcagcaa

SEQ ID NO: 30627 - RNA, 114 nt, synthetic construct
  source 1..114: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 111: mod_base = OTHER; note = uridine phosphorothioate
  modified_base 112: mod_base = OTHER; note = 2'-O-methyl guanosine phosphorothioate
  modified_base 113: mod_base = OTHER; note = 2'-O-methyl uridine phosphorothioate
  modified_base 114: mod_base = OTHER; note = 2'-O-methyl guanosine
actttgctgccacaatccctgttttagagctagaaatagcaagttaaaataaggctagtccgttatcaacttgaaaaagtggcaccgagtcggtgcaagggtctagggattgtg

SEQ ID NO: 30628 - RNA, 120 nt, synthetic construct
  source 1..120: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl guanosine phosphorothioate
  modified_base 120: mod_base = OTHER; note = 2'-O-methyl cytidine
gggtcatagcgaactgagaagttttagagctagaaatagcaagttaaaataaggctagtccgttatcaacttgaaaaagtggcaccgagtcggtgcatcccccggcccttctcagttcgc

SEQ ID NO: 30629 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl adenosine phosphorothioate
  modified_base 123: mod_base = OTHER; note = 2'-O-methyl uridine
gggtcatagcgaactgagaagttttagagctagaaatagcaagttaaaataaggctagtccgttatcaacttgaaaaagtggcaccgagtcggtgcatcccccggcccttctcagttcgctat

SEQ ID NO: 30630 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl guanosine phosphorothioate
  modified_base 120: mod_base = OTHER; note = 2'-O-methyl cytidine phosphorothioate
  modified_base 121: mod_base = OTHER; note = 2'-O-methyl uridine
gggtcatagcgaactgagaagttttagagctagaaatagcaagttaaaataaggctagtccgttatcaacttgaaaaagtggcaccgagtcggtgcatcccccggcccttctcagttcgct

SEQ ID NO: 30631 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl adenosine phosphorothioate
  modified_base 123: mod_base = OTHER; note = 2'-O-methyl uridine phosphorothioate
  modified_base 124: mod_base = OTHER; note = 2'-O-methyl guanosine
gggtcatagcgaactgagaagttttagagctagaaatagcaagttaaaataaggctagtccgttatcaacttgaaaaagtggcaccgagtcggtgcatcccccggcccttctcagttcgctatg

SEQ ID NO: 30632 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl adenosine
gggtcatagcgaactgagaagttttagagctagaaatagcaagttaaaataaggctagtccgttatcaacttgaaaaagtggcaccgagtcggtgcatcccccggcccttctcagttcgcta

SEQ ID NO: 30633 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = adenosine phosphorothioate
  modified_base 123: mod_base = OTHER; note = 2'-O-methyl uridine phosphorothioate
  modified_base 124: mod_base = OTHER; note = 2'-O-methyl guanosine phosphorothioate
  modified_base 125: mod_base = OTHER; note = 2'-O-methyl adenosine
gggtcatagcgaactgagaagttttagagctagaaatagcaagttaaaataaggctagtccgttatcaacttgaaaaagtggcaccgagtcggtgcatcccccggcccttctcagttcgctatga

SEQ ID NO: 30634 - RNA, 119 nt, synthetic construct
  source 1..119: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl guanosine
gggtcatagcgaactgagaagttttagagctagaaatagcaagttaaaataaggctagtccgttatcaacttgaaaaagtggcaccgagtcggtgcatcccccggcccttctcagttcg

SEQ ID NO: 30635 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl guanosine phosphorothioate
  modified_base 125: mod_base = OTHER; note = 2'-O-methyl adenosine phosphorothioate
  modified_base 126: mod_base = OTHER; note = 2'-O-methyl cytidine
gggtcatagcgaactgagaagttttagagctagaaatagcaagttaaaataaggctagtccgttatcaacttgaaaaagtggcaccgagtcggtgcatcccccggcccttctcagttcgctatgac

SEQ ID NO: 30636 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl guanosine phosphorothioate
  modified_base 122: mod_base = OTHER; note = 2'-O-methyl cytidine
gggtcatagcgaactgagaagttttagagctagaaatagcaagttaaaataaggctagtccgttatcaacttgaaaaagtggcaccgagtcggtgccaatcccccggcccttctcagttcgc

SEQ ID NO: 30637 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl guanosine phosphorothioate
  modified_base 122: mod_base = OTHER; note = 2'-O-methyl cytidine phosphorothioate
  modified_base 123: mod_base = OTHER; note = 2'-O-methyl uridine
gggtcatagcgaactgagaagttttagagctagaaatagcaagttaaaataaggctagtccgttatcaacttgaaaaagtggcaccgagtcggtgccaatcccccggcccttctcagttcgct

SEQ ID NO: 30638 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = cytidine phosphorothioate
  modified_base 125: mod_base = OTHER; note = 2'-O-methyl guanosine phosphorothioate
  modified_base 126: mod_base = OTHER; note = 2'-O-methyl cytidine phosphorothioate
  modified_base 127: mod_base = OTHER; note = 2'-O-methyl uridine
gggtcatagcgaactgagaagttttagagctagaaatagcaagttaaaataaggctagtccgttatcaacttgaaaaagtggcaccgagtcggtgcgccacaatcccccggcccttctcagttcgct

SEQ ID NO: 30639 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
tagcgaactgagaagggccggttttagagctagaaatagcaagttaaaataaggctagtccgttatcaacttgaaaaagtggcaccgagtcggtgcgccacaatcccccggcccttctcag

SEQ ID NO: 30640 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = cytidine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl adenosine
tagcgaactgagaagggccggttttagagctagaaatagcaagttaaaataaggctagtccgttatcaacttgaaaaagtggcaccgagtcggtgcgccacaatcccccggcccttctca

SEQ ID NO: 30641 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl cytidine phosphorothioate
  modified_base 118: mod_base = OTHER; note = 2'-O-methyl uridine phosphorothioate
  modified_base 119: mod_base = OTHER; note = 2'-O-methyl cytidine
tagcgaactgagaagggccggttttagagctagaaatagcaagttaaaataaggctagtccgttatcaacttgaaaaagtggcaccgagtcggtgcgccacaatcccccggcccttctc

SEQ ID NO: 30642 - RNA, 115 nt, synthetic construct
  source 1..115: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = uridine phosphorothioate
  modified_base 113: mod_base = OTHER; note = 2'-O-methyl cytidine phosphorothioate
  modified_base 114: mod_base = OTHER; note = 2'-O-methyl adenosine phosphorothioate
  modified_base 115: mod_base = OTHER; note = 2'-O-methyl guanosine
tagcgaactgagaagggccggttttagagctagaaatagcaagttaaaataaggctagtccgttatcaacttgaaaaagtggcaccgagtcggtgcatcccccggcccttctcag

SEQ ID NO: 30643 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl adenosine phosphorothioate
  modified_base 121: mod_base = OTHER; note = 2'-O-methyl guanosine phosphorothioate
  modified_base 122: mod_base = OTHER; note = 2'-O-methyl uridine
tagcgaactgagaagggccggttttagagctagaaatagcaagttaaaataaggctagtccgttatcaacttgaaaaagtggcaccgagtcggtgcgccacaatcccccggcccttctcagt

SEQ ID NO: 30644 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl adenosine phosphorothioate
  modified_base 127: mod_base = OTHER; note = 2'-O-methyl guanosine
tagcgaactgagaagggccggttttagagctagaaatagcaagttaaaataaggctagtccgttatcaacttgaaaaagtggcaccgagtcggtgctttgctgccacaatcccccggcccttctcag

SEQ ID NO: 30645 - RNA, 114 nt, synthetic construct
  source 1..114: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 111: mod_base = OTHER; note = cytidine phosphorothioate
  modified_base 112: mod_base = OTHER; note = 2'-O-methyl uridine phosphorothioate
  modified_base 113: mod_base = OTHER; note = 2'-O-methyl cytidine phosphorothioate
  modified_base 114: mod_base = OTHER; note = 2'-O-methyl adenosine
tagcgaactgagaagggccggttttagagctagaaatagcaagttaaaataaggctagtccgttatcaacttgaaaaagtggcaccgagtcggtgcatcccccggcccttctca

SEQ ID NO: 30646 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl adenosine
tagcgaactgagaagggccggttttagagctagaaatagcaagttaaaataaggctagtccgttatcaacttgaaaaagtggcaccgagtcggtgctttgctgccacaatcccccggcccttctca

SEQ ID NO: 30647 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = cytidine phosphorothioate
  modified_base 114: mod_base = OTHER; note = 2'-O-methyl adenosine phosphorothioate
  modified_base 115: mod_base = OTHER; note = 2'-O-methyl guanosine phosphorothioate
  modified_base 116: mod_base = OTHER; note = 2'-O-methyl uridine
tagcgaactgagaagggccggttttagagctagaaatagcaagttaaaataaggctagtccgttatcaacttgaaaaagtggcaccgagtcggtgcatcccccggcccttctcagt

SEQ ID NO: 30648 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = adenosine phosphorothioate
  modified_base 121: mod_base = OTHER; note = 2'-O-methyl guanosine phosphorothioate
  modified_base 122: mod_base = OTHER; note = 2'-O-methyl uridine phosphorothioate
  modified_base 123: mod_base = OTHER; note = 2'-O-methyl uridine
tagcgaactgagaagggccggttttagagctagaaatagcaagttaaaataaggctagtccgttatcaacttgaaaaagtggcaccgagtcggtgcgccacaatcccccggcccttctcagtt

SEQ ID NO: 30649 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl adenosine
tagcgaactgagaagggccggttttagagctagaaatagcaagttaaaataaggctagtccgttatcaacttgaaaaagtggcaccgagtcggtgctgctgccacaatcccccggcccttctca

SEQ ID NO: 30650 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
tagcgaactgagaagggccggttttagagctagaaatagcaagttaaaataaggctagtccgttatcaacttgaaaaagtggcaccgagtcggtgctgctgccacaatcccccggcccttctcag

SEQ ID NO: 30651 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl cytidine phosphorothioate
  modified_base 118: mod_base = OTHER; note = 2'-O-methyl uridine phosphorothioate
  modified_base 119: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcgccacaatcccccggcccttctc

SEQ ID NO: 30652 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
agcgaactgagaagggccgagttttagagctagaaatagcaagttaaaataaggctagtccgttatcaacttgaaaaagtggcaccgagtcggtgcgccacaatcccccggcccttctcag

SEQ ID NO: 30653 - RNA, 127 nt, synthetic construct
  source 1..127: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl uridine phosphorothioate
  modified_base 127: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcactttgctgccacaatcccccggcccttctc

SEQ ID NO: 30654 - RNA, 128 nt, synthetic construct
  source 1..128: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl adenosine
agcgaactgagaagggccgagttttagagctagaaatagcaagttaaaataaggctagtccgttatcaacttgaaaaagtggcaccgagtcggtgcactttgctgccacaatcccccggcccttctca

SEQ ID NO: 30655 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl uridine
agcgaactgagaagggccgagttttagagctagaaatagcaagttaaaataaggctagtccgttatcaacttgaaaaagtggcaccgagtcggtgctttgctgccacaatcccccggcccttct

SEQ ID NO: 30656 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl uridine phosphorothioate
  modified_base 117: mod_base = OTHER; note = 2'-O-methyl cytidine phosphorothioate
  modified_base 118: mod_base = OTHER; note = 2'-O-methyl uridine
agcgaactgagaagggccgagttttagagctagaaatagcaagttaaaataaggctagtccgttatcaacttgaaaaagtggcaccgagtcggtgcgccacaatcccccggcccttct

SEQ ID NO: 30657 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl uridine phosphorothioate
  modified_base 123: mod_base = OTHER; note = 2'-O-methyl cytidine
agcgaactgagaagggccgagttttagagctagaaatagcaagttaaaataaggctagtccgttatcaacttgaaaaagtggcaccgagtcggtgctttgctgccacaatcccccggcccttc

SEQ ID NO: 30658 - RNA, 115 nt, synthetic construct
  source 1..115: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = uridine phosphorothioate
  modified_base 113: mod_base = OTHER; note = 2'-O-methyl cytidine phosphorothioate
  modified_base 114: mod_base = OTHER; note = 2'-O-methyl adenosine phosphorothioate
  modified_base 115: mod_base = OTHER; note = 2'-O-methyl guanosine
agcgaactgagaagggccgagttttagagctagaaatagcaagttaaaataaggctagtccgttatcaacttgaaaaagtggcaccgagtcggtgcatcccccggcccttctcag

SEQ ID NO: 30659 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = cytidine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl adenosine
agcgaactgagaagggccgagttttagagctagaaatagcaagttaaaataaggctagtccgttatcaacttgaaaaagtggcaccgagtcggtgcgccacaatcccccggcccttctca

SEQ ID NO: 30660 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl uridine phosphorothioate
  modified_base 118: mod_base = OTHER; note = 2'-O-methyl uridine phosphorothioate
  modified_base 119: mod_base = OTHER; note = 2'-O-methyl cytidine
agcgaactgagaagggccgagttttagagctagaaatagcaagttaaaataaggctagtccgttatcaacttgaaaaagtggcaccgagtcggtgcctgccacaatcccccggcccttc

SEQ ID NO: 30661 - RNA, 115 nt, synthetic construct
  source 1..115: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = uridine phosphorothioate
  modified_base 113: mod_base = OTHER; note = 2'-O-methyl cytidine phosphorothioate
  modified_base 114: mod_base = OTHER; note = 2'-O-methyl uridine phosphorothioate
  modified_base 115: mod_base = OTHER; note = 2'-O-methyl cytidine
agcgaactgagaagggccgagttttagagctagaaatagcaagttaaaataaggctagtccgttatcaacttgaaaaagtggcaccgagtcggtgccaatcccccggcccttctc

SEQ ID NO: 30662 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl guanosine phosphorothioate
  modified_base 3: mod_base = OTHER; note = 2'-O-methyl cytidine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = cytidine phosphorothioate
  modified_base 116: mod_base = OTHER; note = 2'-O-methyl adenosine phosphorothioate
  modified_base 117: mod_base = OTHER; note = 2'-O-methyl guanosine phosphorothioate
  modified_base 118: mod_base = OTHER; note = 2'-O-methyl uridine
agcgaactgagaagggccgagttttagagctagaaatagcaagttaaaataaggctagtccgttatcaacttgaaaaagtggcaccgagtcggtgccaatcccccggcccttctcagt

SEQ ID NO: 30663 - RNA, 115 nt, synthetic construct
  source 1..115: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = guanosine phosphorothioate
  modified_base 113: mod_base = OTHER; note = 2'-O-methyl cytidine phosphorothioate
  modified_base 114: mod_base = OTHER; note = 2'-O-methyl adenosine phosphorothioate
  modified_base 115: mod_base = OTHER; note = 2'-O-methyl guanosine
actttgctgccacaatccctgttttagagctagaaatagcaagttaaaataaggctagtccgttatcaacttgaaaaagtggcaccgagtcggtgcggccgggggattgtggcag

SEQ ID NO: 30664 - RNA, 116 nt, synthetic construct
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = cytidine phosphorothioate
  modified_base 114: mod_base = OTHER; note = 2'-O-methyl adenosine phosphorothioate
  modified_base 115: mod_base = OTHER; note = 2'-O-methyl guanosine phosphorothioate
  modified_base 116: mod_base = OTHER; note = 2'-O-methyl cytidine
actttgctgccacaatccctgttttagagctagaaatagcaagttaaaataaggctagtccgttatcaacttgaaaaagtggcaccgagtcggtgcggccgggggattgtggcagc

SEQ ID NO: 30665 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = adenosine phosphorothioate
  modified_base 115: mod_base = OTHER; note = 2'-O-methyl guanosine phosphorothioate
  modified_base 116: mod_base = OTHER; note = 2'-O-methyl cytidine phosphorothioate
  modified_base 117: mod_base = OTHER; note = 2'-O-methyl adenosine
actttgctgccacaatccctgttttagagctagaaatagcaagttaaaataaggctagtccgttatcaacttgaaaaagtggcaccgagtcggtgcggccgggggattgtggcagca

SEQ ID NO: 30666 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = guanosine phosphorothioate
  modified_base 115: mod_base = OTHER; note = 2'-O-methyl cytidine phosphorothioate
  modified_base 116: mod_base = OTHER; note = 2'-O-methyl adenosine phosphorothioate
  modified_base 117: mod_base = OTHER; note = 2'-O-methyl guanosine
actttgctgccacaatccctgttttagagctagaaatagcaagttaaaataaggctagtccgttatcaacttgaaaaagtggcaccgagtcggtgcagggccgggggattgtggcag

SEQ ID NO: 30667 - RNA, 114 nt, synthetic construct
  source 1..114: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 111: mod_base = OTHER; note = guanosine phosphorothioate
  modified_base 112: mod_base = OTHER; note = 2'-O-methyl guanosine phosphorothioate
  modified_base 113: mod_base = OTHER; note = 2'-O-methyl cytidine phosphorothioate
  modified_base 114: mod_base = OTHER; note = 2'-O-methyl adenosine
actttgctgccacaatccctgttttagagctagaaatagcaagttaaaataaggctagtccgttatcaacttgaaaaagtggcaccgagtcggtgcggccgggggattgtggca

SEQ ID NO: 30668 - RNA, 116 nt, synthetic construct
  source 1..116: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = guanosine phosphorothioate
  modified_base 114: mod_base = OTHER; note = 2'-O-methyl guanosine phosphorothioate
  modified_base 115: mod_base = OTHER; note = 2'-O-methyl cytidine phosphorothioate
  modified_base 116: mod_base = OTHER; note = 2'-O-methyl adenosine
actttgctgccacaatccctgttttagagctagaaatagcaagttaaaataaggctagtccgttatcaacttgaaaaagtggcaccgagtcggtgcagggccgggggattgtggca

SEQ ID NO: 30669 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = cytidine phosphorothioate
  modified_base 116: mod_base = OTHER; note = 2'-O-methyl adenosine phosphorothioate
  modified_base 117: mod_base = OTHER; note = 2'-O-methyl guanosine phosphorothioate
  modified_base 118: mod_base = OTHER; note = 2'-O-methyl cytidine
actttgctgccacaatccctgttttagagctagaaatagcaagttaaaataaggctagtccgttatcaacttgaaaaagtggcaccgagtcggtgcagggccgggggattgtggcagc

SEQ ID NO: 30670 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl adenosine
actttgctgccacaatccctgttttagagctagaaatagcaagttaaaataaggctagtccgttatcaacttgaaaaagtggcaccgagtcggtgcggccgggggattgtggcagcaa

SEQ ID NO: 30671 - RNA, 115 nt, synthetic construct
  source 1..115: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 112: mod_base = OTHER; note = uridine phosphorothioate
  modified_base 113: mod_base = OTHER; note = 2'-O-methyl guanosine phosphorothioate
  modified_base 114: mod_base = OTHER; note = 2'-O-methyl guanosine phosphorothioate
  modified_base 115: mod_base = OTHER; note = 2'-O-methyl cytidine
actttgctgccacaatccctgttttagagctagaaatagcaagttaaaataaggctagtccgttatcaacttgaaaaagtggcaccgagtcggtgcagggccgggggattgtggc

SEQ ID NO: 30672 - RNA, 113 nt, synthetic construct
  source 1..113: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 110: mod_base = OTHER; note = uridine phosphorothioate
  modified_base 111: mod_base = OTHER; note = 2'-O-methyl guanosine phosphorothioate
  modified_base 112: mod_base = OTHER; note = 2'-O-methyl guanosine phosphorothioate
  modified_base 113: mod_base = OTHER; note = 2'-O-methyl cytidine
actttgctgccacaatccctgttttagagctagaaatagcaagttaaaataaggctagtccgttatcaacttgaaaaagtggcaccgagtcggtgcggccgggggattgtggc

SEQ ID NO: 30673 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
actttgctgccacaatccctgttttagagctagaaatagcaagttaaaataaggctagtccgttatcaacttgaaaaagtggcaccgagtcggtgcgaagggccgggggattgtggcag

SEQ ID NO: 30674 - RNA, 131 nt, synthetic construct
  source 1..131: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 128: mod_base = OTHER; note = guanosine phosphorothioate
  modified_base 129: mod_base = OTHER; note = 2'-O-methyl cytidine phosphorothioate
  modified_base 130: mod_base = OTHER; note = 2'-O-methyl uridine phosphorothioate
  modified_base 131: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcgctgccacaatacctcggcccttctcagttcgcta

SEQ ID NO: 30675 - RNA, 131 nt, synthetic construct
  source 1..131: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 128: mod_base = OTHER; note = guanosine phosphorothioate
  modified_base 129: mod_base = OTHER; note = 2'-O-methyl cytidine phosphorothioate
  modified_base 130: mod_base = OTHER; note = 2'-O-methyl uridine phosphorothioate
  modified_base 131: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcgctgccacaataccgcggcccttctcagttcgcta

SEQ ID NO: 30676 - RNA, 131 nt, synthetic construct
  source 1..131: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 128: mod_base = OTHER; note = guanosine phosphorothioate
  modified_base 129: mod_base = OTHER; note = 2'-O-methyl cytidine phosphorothioate
  modified_base 130: mod_base = OTHER; note = 2'-O-methyl uridine phosphorothioate
  modified_base 131: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcgctgccacaatccctcggcccttctcagttcgcta

SEQ ID NO: 30677 - RNA, 131 nt, synthetic construct
  source 1..131: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 128: mod_base = OTHER; note = guanosine phosphorothioate
  modified_base 129: mod_base = OTHER; note = 2'-O-methyl cytidine phosphorothioate
  modified_base 130: mod_base = OTHER; note = 2'-O-methyl uridine phosphorothioate
  modified_base 131: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcgctgccacaatacctcgccccttctcagttcgcta

SEQ ID NO: 30678 - RNA, 131 nt, synthetic construct
  source 1..131: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 128: mod_base = OTHER; note = guanosine phosphorothioate
  modified_base 129: mod_base = OTHER; note = 2'-O-methyl cytidine phosphorothioate
  modified_base 130: mod_base = OTHER; note = 2'-O-methyl uridine phosphorothioate
  modified_base 131: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcgctgccacaataccgcgccccttctcagttcgcta

SEQ ID NO: 30679 - RNA, 131 nt, synthetic construct
  source 1..131: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 128: mod_base = OTHER; note = guanosine phosphorothioate
  modified_base 129: mod_base = OTHER; note = 2'-O-methyl cytidine phosphorothioate
  modified_base 130: mod_base = OTHER; note = 2'-O-methyl uridine phosphorothioate
  modified_base 131: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcgctgccacaataccgcgcccattctcagttcgcta

SEQ ID NO: 30680 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = guanosine phosphorothioate
  modified_base 127: mod_base = OTHER; note = 2'-O-methyl cytidine phosphorothioate
  modified_base 128: mod_base = OTHER; note = 2'-O-methyl uridine phosphorothioate
  modified_base 129: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgctgccacaatacctcggcccttctcagttcgcta

SEQ ID NO: 30681 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = guanosine phosphorothioate
  modified_base 127: mod_base = OTHER; note = 2'-O-methyl cytidine phosphorothioate
  modified_base 128: mod_base = OTHER; note = 2'-O-methyl uridine phosphorothioate
  modified_base 129: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgctgccacaataccgcggcccttctcagttcgcta

SEQ ID NO: 30682 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = guanosine phosphorothioate
  modified_base 127: mod_base = OTHER; note = 2'-O-methyl cytidine phosphorothioate
  modified_base 128: mod_base = OTHER; note = 2'-O-methyl uridine phosphorothioate
  modified_base 129: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgctgccacaatccctcggcccttctcagttcgcta

SEQ ID NO: 30683 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = guanosine phosphorothioate
  modified_base 127: mod_base = OTHER; note = 2'-O-methyl cytidine phosphorothioate
  modified_base 128: mod_base = OTHER; note = 2'-O-methyl uridine phosphorothioate
  modified_base 129: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgctgccacaatacctcgccccttctcagttcgcta

SEQ ID NO: 30684 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = guanosine phosphorothioate
  modified_base 127: mod_base = OTHER; note = 2'-O-methyl cytidine phosphorothioate
  modified_base 128: mod_base = OTHER; note = 2'-O-methyl uridine phosphorothioate
  modified_base 129: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgctgccacaataccgcgccccttctcagttcgcta

SEQ ID NO: 30685 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = guanosine phosphorothioate
  modified_base 127: mod_base = OTHER; note = 2'-O-methyl cytidine phosphorothioate
  modified_base 128: mod_base = OTHER; note = 2'-O-methyl uridine phosphorothioate
  modified_base 129: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgctgccacaataccgcgcccattctcagttcgcta

SEQ ID NO: 30686 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl uridine phosphorothioate
  modified_base 127: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcccacaatacctcggcccttctcagttcgcta

SEQ ID NO: 30687 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl uridine phosphorothioate
  modified_base 127: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcccacaataccgcggcccttctcagttcgcta

SEQ ID NO: 30688 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl uridine phosphorothioate
  modified_base 127: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcccacaatccctcggcccttctcagttcgcta

SEQ ID NO: 30689 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl uridine phosphorothioate
  modified_base 127: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcccacaatacctcgccccttctcagttcgcta

SEQ ID NO: 30690 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl uridine phosphorothioate
  modified_base 127: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcccacaataccgcgccccttctcagttcgcta

SEQ ID NO: 30691 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl uridine phosphorothioate
  modified_base 127: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcccacaataccgcgcccattctcagttcgcta

SEQ ID NO: 30692 - RNA, 125 nt, synthetic construct; identical to SEQ ID NO: 30562
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine

SEQ ID NO: 30693 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcacaataccgcggcccttctcagttcgcta

SEQ ID NO: 30694 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcacaatccctcggcccttctcagttcgcta

SEQ ID NO: 30695 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcacaatacctcgccccttctcagttcgcta

SEQ ID NO: 30696 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcacaataccgcgccccttctcagttcgcta

SEQ ID NO: 30697 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl uridine phosphorothioate
  modified_base 125: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcacaataccgcgcccattctcagttcgcta

SEQ ID NO: 30698 - RNA, 123 nt, synthetic construct; identical to SEQ ID NO: 30559
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine

SEQ ID NO: 30699 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcaataccgcggcccttctcagttcgcta

SEQ ID NO: 30700 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcaatccctcggcccttctcagttcgcta

SEQ ID NO: 30701 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcaatacctcgccccttctcagttcgcta

SEQ ID NO: 30702 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcaataccgcgccccttctcagttcgcta

SEQ ID NO: 30703 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl uridine phosphorothioate
  modified_base 123: mod_base = OTHER; note = 2'-O-methyl adenosine
tgggtcgtagcgaactgagagttttagagctagaaatagcaagttaaaataaggctagtccgttatcaacttgaaaaagtggcaccgagtcggtgcaataccgcgcccattctcagttcgcta

SEQ ID NO: 30704 - RNA, 130 nt, synthetic construct
  source 1..130: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcgctgccacaatacctcggcccttctcagttcgct

SEQ ID NO: 30705 - RNA, 130 nt, synthetic construct
  source 1..130: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcgctgccacaataccgcggcccttctcagttcgct

SEQ ID NO: 30706 - RNA, 130 nt, synthetic construct
  source 1..130: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcgctgccacaatccctcggcccttctcagttcgct

SEQ ID NO: 30707 - RNA, 130 nt, synthetic construct
  source 1..130: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcgctgccacaatacctcgccccttctcagttcgct

SEQ ID NO: 30708 - RNA, 130 nt, synthetic construct
  source 1..130: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcgctgccacaataccgcgccccttctcagttcgct

SEQ ID NO: 30709 - RNA, 130 nt, synthetic construct
  source 1..130: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcgctgccacaataccgcgcccattctcagttcgct

SEQ ID NO: 30710 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgctgccacaatacctcggcccttctcagttcgct

SEQ ID NO: 30711 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgctgccacaataccgcggcccttctcagttcgct

SEQ ID NO: 30712 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgctgccacaatccctcggcccttctcagttcgct

SEQ ID NO: 30713 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgctgccacaatacctcgccccttctcagttcgct

SEQ ID NO: 30714 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgctgccacaataccgcgccccttctcagttcgct

SEQ ID NO: 30715 - RNA, 128 nt, synthetic construct
  source 1..128: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgctgccacaataccgcgcccattctcagttcgct

SEQ ID NO: 30716 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcccacaatacctcggcccttctcagttcgct

SEQ ID NO: 30717 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcccacaataccgcggcccttctcagttcgct

SEQ ID NO: 30718 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcccacaatccctcggcccttctcagttcgct

SEQ ID NO: 30719 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcccacaatacctcgccccttctcagttcgct

SEQ ID NO: 30720 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcccacaataccgcgccccttctcagttcgct

SEQ ID NO: 30721 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcccacaataccgcgcccattctcagttcgct

SEQ ID NO: 30722 - RNA, 124 nt, synthetic construct; identical to SEQ ID NO: 30486
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine

SEQ ID NO: 30723 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcacaataccgcggcccttctcagttcgct

SEQ ID NO: 30724 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcacaatccctcggcccttctcagttcgct

SEQ ID NO: 30725 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcacaatacctcgccccttctcagttcgct

SEQ ID NO: 30726 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcacaataccgcgccccttctcagttcgct

SEQ ID NO: 30727 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcacaataccgcgcccattctcagttcgct

SEQ ID NO: 30728 - RNA, 122 nt, synthetic construct; identical to SEQ ID NO: 30485
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine

SEQ ID NO: 30729 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcaataccgcggcccttctcagttcgct

SEQ ID NO: 30730 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcaatccctcggcccttctcagttcgct

SEQ ID NO: 30731 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcaatacctcgccccttctcagttcgct

SEQ ID NO: 30732 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcaataccgcgccccttctcagttcgct

SEQ ID NO: 30733 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
tgggtcgtagcgaactgagagttttagagctagaaatagcaagttaaaataaggctagtccgttatcaacttgaaaaagtggcaccgagtcggtgcaataccgcgcccattctcagttcgct

SEQ ID NO: 30734 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcgctgccacaatacctcggcccttctcagttcgc

SEQ ID NO: 30735 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcgctgccacaataccgcggcccttctcagttcgc

SEQ ID NO: 30736 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcgctgccacaatccctcggcccttctcagttcgc

SEQ ID NO: 30737 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcgctgccacaatacctcgccccttctcagttcgc

SEQ ID NO: 30738 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcgctgccacaataccgcgccccttctcagttcgc

SEQ ID NO: 30739 - RNA, 129 nt, synthetic construct
  source 1..129: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcgctgccacaataccgcgcccattctcagttcgc

SEQ ID NO: 30740 - RNA, 127 nt, synthetic construct; identical to SEQ ID NO: 30561
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine

SEQ ID NO: 30741 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgctgccacaataccgcggcccttctcagttcgc

SEQ ID NO: 30742 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgctgccacaatccctcggcccttctcagttcgc

SEQ ID NO: 30743 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgctgccacaatacctcgccccttctcagttcgc

SEQ ID NO: 30744 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgctgccacaataccgcgccccttctcagttcgc

SEQ ID NO: 30745 - RNA, 127 nt, synthetic construct
  source 1..127: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgctgccacaataccgcgcccattctcagttcgc

SEQ ID NO: 30746 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcccacaatacctcggcccttctcagttcgc

SEQ ID NO: 30747 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcccacaataccgcggcccttctcagttcgc

SEQ ID NO: 30748 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcccacaatccctcggcccttctcagttcgc

SEQ ID NO: 30749 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcccacaatacctcgccccttctcagttcgc

SEQ ID NO: 30750 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcccacaataccgcgccccttctcagttcgc

SEQ ID NO: 30751 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcccacaataccgcgcccattctcagttcgc

SEQ ID NO: 30752 - RNA, 123 nt, synthetic construct; identical to SEQ ID NO: 30557
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine

SEQ ID NO: 30753 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaataccgcggcccttctcagttcgc

SEQ ID NO: 30754 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaatccctcggcccttctcagttcgc

SEQ ID NO: 30755 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaatacctcgccccttctcagttcgc

SEQ ID NO: 30756 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaataccgcgccccttctcagttcgc

SEQ ID NO: 30757 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcacaataccgcgcccattctcagttcgc

SEQ ID NO: 30758 - RNA, 121 nt, synthetic construct; identical to SEQ ID NO: 30496
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine

SEQ ID NO: 30759 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaataccgcggcccttctcagttcgc

SEQ ID NO: 30760 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaatccctcggcccttctcagttcgc

SEQ ID NO: 30761 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaatacctcgccccttctcagttcgc

SEQ ID NO: 30762 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaataccgcgccccttctcagttcgc

SEQ ID NO: 30763 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
tgggtcgtagcgaactgagagttttagagctagaaatagcaagttaaaataaggctagtccgttatcaacttgaaaaagtggcaccgagtcggtgcaataccgcgcccattctcagttcgc

SEQ ID NO: 30764 - RNA, 130 nt, synthetic construct
  source 1..130: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcgctgccacaatacctcggcccttctcagttcgct

SEQ ID NO: 30765 - RNA, 130 nt, synthetic construct
  source 1..130: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcgctgccacaataccgcggcccttctcagttcgct

SEQ ID NO: 30766 - RNA, 130 nt, synthetic construct
  source 1..130: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcgctgccacaatacctcgccccttctcagttcgct

SEQ ID NO: 30767 - RNA, 130 nt, synthetic construct
  source 1..130: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcgctgccacaatacctcgcccattctcagttcgct

SEQ ID NO: 30768 - RNA, 130 nt, synthetic construct
  source 1..130: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcgctgccacaataccgcgccccttctcagttcgct

SEQ ID NO: 30769 - RNA, 130 nt, synthetic construct
  source 1..130: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 127: mod_base = OTHER; note = cytidine phosphorothioate
  modified_base 128: mod_base = OTHER; note = 2'-O-methyl guanosine phosphorothioate
  modified_base 129: mod_base = OTHER; note = 2'-O-methyl cytidine phosphorothioate
  modified_base 130: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcgctgccacaataccgcgcccattctcagttcgct

SEQ ID NO: 30770 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgctgccacaatacctcggcccttctcagttcgct

SEQ ID NO: 30771 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgctgccacaataccgcggcccttctcagttcgct

SEQ ID NO: 30772 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgctgccacaatacctcgccccttctcagttcgct

SEQ ID NO: 30773 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgctgccacaatacctcgcccattctcagttcgct

SEQ ID NO: 30774 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgctgccacaataccgcgccccttctcagttcgct

SEQ ID NO: 30775 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = cytidine phosphorothioate
  modified_base 126: mod_base = OTHER; note = 2'-O-methyl guanosine phosphorothioate
  modified_base 127: mod_base = OTHER; note = 2'-O-methyl cytidine phosphorothioate
  modified_base 128: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgctgccacaataccgcgcccattctcagttcgct

SEQ ID NO: 30776 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcccacaatacctcggcccttctcagttcgct

SEQ ID NO: 30777 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcccacaataccgcggcccttctcagttcgct

SEQ ID NO: 30778 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcccacaatacctcgccccttctcagttcgct

SEQ ID NO: 30779 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcccacaatacctcgcccattctcagttcgct

SEQ ID NO: 30780 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcccacaataccgcgccccttctcagttcgct

SEQ ID NO: 30781 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = cytidine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcccacaataccgcgcccattctcagttcgct

SEQ ID NO: 30782 - RNA, 124 nt, synthetic construct; identical to SEQ ID NO: 30549
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine

SEQ ID NO: 30783 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcacaataccgcggcccttctcagttcgct

SEQ ID NO: 30784 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcacaatacctcgccccttctcagttcgct

SEQ ID NO: 30785 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcacaatacctcgcccattctcagttcgct

SEQ ID NO: 30786 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcacaataccgcgccccttctcagttcgct

SEQ ID NO: 30787 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = cytidine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcacaataccgcgcccattctcagttcgct

SEQ ID NO: 30788 - RNA, 122 nt, synthetic construct; identical to SEQ ID NO: 30488
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine

SEQ ID NO: 30789 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcaataccgcggcccttctcagttcgct

SEQ ID NO: 30790 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcaatacctcgccccttctcagttcgct

SEQ ID NO: 30791 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcaatacctcgcccattctcagttcgct

SEQ ID NO: 30792 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcaataccgcgccccttctcagttcgct

SEQ ID NO: 30793 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = cytidine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl uridine
gggtcgtagcgaactgagaagttttagagctagaaatagcaagttaaaataaggctagtccgttatcaacttgaaaaagtggcaccgagtcggtgcaataccgcgcccattctcagttcgct

SEQ ID NO: 30794 - RNA, 129 nt, synthetic construct; identical to SEQ ID NO: 30554
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine

SEQ ID NO: 30795 - RNA, 129 nt, synthetic construct
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcgctgccacaataccgcggcccttctcagttcgc

SEQ ID NO: 30796 - RNA, 129 nt, synthetic construct
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcgctgccacaatacctcgccccttctcagttcgc

SEQ ID NO: 30797 - RNA, 129 nt, synthetic construct
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcgctgccacaatacctcgcccattctcagttcgc

SEQ ID NO: 30798 - RNA, 129 nt, synthetic construct
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcgctgccacaataccgcgccccttctcagttcgc

SEQ ID NO: 30799 - RNA, 129 nt, synthetic construct
  source 1..129: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 126: mod_base = OTHER; note = uridine phosphorothioate
  modified_base 127: mod_base = OTHER; note = 2'-O-methyl cytidine phosphorothioate
  modified_base 128: mod_base = OTHER; note = 2'-O-methyl guanosine phosphorothioate
  modified_base 129: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcgctgccacaataccgcgcccattctcagttcgc

SEQ ID NO: 30800 - RNA, 127 nt, synthetic construct; identical to SEQ ID NO: 30498
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine

SEQ ID NO: 30801 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctgccacaataccgcggcccttctcagttcgc

SEQ ID NO: 30802 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctgccacaatacctcgccccttctcagttcgc

SEQ ID NO: 30803 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctgccacaatacctcgcccattctcagttcgc

SEQ ID NO: 30804 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctgccacaataccgcgccccttctcagttcgc

SEQ ID NO: 30805 - RNA, 127 nt, synthetic construct
  source 1..127: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = uridine phosphorothioate
  modified_base 125: mod_base = OTHER; note = 2'-O-methyl cytidine phosphorothioate
  modified_base 126: mod_base = OTHER; note = 2'-O-methyl guanosine phosphorothioate
  modified_base 127: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgctgccacaataccgcgcccattctcagttcgc

SEQ ID NO: 30806 - RNA, 125 nt, synthetic construct; identical to SEQ ID NO: 30552
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine

SEQ ID NO: 30807 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcccacaataccgcggcccttctcagttcgc

SEQ ID NO: 30808 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcccacaatacctcgccccttctcagttcgc

SEQ ID NO: 30809 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcccacaatacctcgcccattctcagttcgc

SEQ ID NO: 30810 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcccacaataccgcgccccttctcagttcgc

SEQ ID NO: 30811 - RNA, 125 nt, synthetic construct
  source 1..125: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl cytidine phosphorothioate
  modified_base 124: mod_base = OTHER; note = 2'-O-methyl guanosine phosphorothioate
  modified_base 125: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcccacaataccgcgcccattctcagttcgc

SEQ ID NO: 30812 - RNA, 123 nt, synthetic construct; identical to SEQ ID NO: 30497
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine

SEQ ID NO: 30813 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcacaataccgcggcccttctcagttcgc

SEQ ID NO: 30814 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcacaatacctcgccccttctcagttcgc

SEQ ID NO: 30815 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcacaatacctcgcccattctcagttcgc

SEQ ID NO: 30816 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcacaataccgcgccccttctcagttcgc

SEQ ID NO: 30817 - RNA, 123 nt, synthetic construct
  source 1..123: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl cytidine phosphorothioate
  modified_base 122: mod_base = OTHER; note = 2'-O-methyl guanosine phosphorothioate
  modified_base 123: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcacaataccgcgcccattctcagttcgc

SEQ ID NO: 30818 - RNA, 121 nt, synthetic construct; identical to SEQ ID NO: 30487
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine

SEQ ID NO: 30819 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcaataccgcggcccttctcagttcgc

SEQ ID NO: 30820 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcaatacctcgccccttctcagttcgc

SEQ ID NO: 30821 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcaatacctcgcccattctcagttcgc

SEQ ID NO: 30822 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcaataccgcgccccttctcagttcgc

SEQ ID NO: 30823 - RNA, 121 nt, synthetic construct
  source 1..121: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl cytidine phosphorothioate
  modified_base 120: mod_base = OTHER; note = 2'-O-methyl guanosine phosphorothioate
  modified_base 121: mod_base = OTHER; note = 2'-O-methyl cytidine
gggtcgtagcgaactgagaagttttagagctagaaatagcaagttaaaataaggctagtccgttatcaacttgaaaaagtggcaccgagtcggtgcaataccgcgcccattctcagttcgc

SEQ ID NO: 30824 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcgctgccacaatacctcggcccttctcagttcg

SEQ ID NO: 30825 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcgctgccacaataccgcggcccttctcagttcg

SEQ ID NO: 30826 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcgctgccacaatacctcgccccttctcagttcg

SEQ ID NO: 30827 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcgctgccacaatacctcgcccattctcagttcg

SEQ ID NO: 30828 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcgctgccacaataccgcgccccttctcagttcg

SEQ ID NO: 30829 - RNA, 128 nt, synthetic construct
  source 1..128: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 125: mod_base = OTHER; note = uridine phosphorothioate
  modified_base 126: mod_base = OTHER; note = 2'-O-methyl uridine phosphorothioate
  modified_base 127: mod_base = OTHER; note = 2'-O-methyl cytidine phosphorothioate
  modified_base 128: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcgctgccacaataccgcgcccattctcagttcg

SEQ ID NO: 30830 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgctgccacaatacctcggcccttctcagttcg

SEQ ID NO: 30831 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgctgccacaataccgcggcccttctcagttcg

SEQ ID NO: 30832 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgctgccacaatacctcgccccttctcagttcg

SEQ ID NO: 30833 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgctgccacaatacctcgcccattctcagttcg

SEQ ID NO: 30834 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgctgccacaataccgcgccccttctcagttcg

SEQ ID NO: 30835 - RNA, 126 nt, synthetic construct
  source 1..126: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl uridine phosphorothioate
  modified_base 125: mod_base = OTHER; note = 2'-O-methyl cytidine phosphorothioate
  modified_base 126: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgctgccacaataccgcgcccattctcagttcg

SEQ ID NO: 30836 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcccacaatacctcggcccttctcagttcg

SEQ ID NO: 30837 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcccacaataccgcggcccttctcagttcg

SEQ ID NO: 30838 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcccacaatacctcgccccttctcagttcg

SEQ ID NO: 30839 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcccacaatacctcgcccattctcagttcg

SEQ ID NO: 30840 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcccacaataccgcgccccttctcagttcg

SEQ ID NO: 30841 - RNA, 124 nt, synthetic construct
  source 1..124: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl uridine phosphorothioate
  modified_base 123: mod_base = OTHER; note = 2'-O-methyl cytidine phosphorothioate
  modified_base 124: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcccacaataccgcgcccattctcagttcg

SEQ ID NO: 30842 - RNA, 122 nt, synthetic construct; identical to SEQ ID NO: 30551
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine

SEQ ID NO: 30843 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcacaataccgcggcccttctcagttcg

SEQ ID NO: 30844 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcacaatacctcgccccttctcagttcg

SEQ ID NO: 30845 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcacaatacctcgcccattctcagttcg

SEQ ID NO: 30846 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcacaataccgcgccccttctcagttcg

SEQ ID NO: 30847 - RNA, 122 nt, synthetic construct
  source 1..122: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl uridine phosphorothioate
  modified_base 121: mod_base = OTHER; note = 2'-O-methyl cytidine phosphorothioate
  modified_base 122: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcacaataccgcgcccattctcagttcg

SEQ ID NO: 30848 - RNA, 120 nt, synthetic construct
  source 1..120: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcaatacctcggcccttctcagttcg

SEQ ID NO: 30849 - RNA, 120 nt, synthetic construct
  source 1..120: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcaataccgcggcccttctcagttcg

SEQ ID NO: 30850 - RNA, 120 nt, synthetic construct
  source 1..120: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcaatacctcgccccttctcagttcg

SEQ ID NO: 30851 - RNA, 120 nt, synthetic construct
  source 1..120: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcaatacctcgcccattctcagttcg

SEQ ID NO: 30852 - RNA, 120 nt, synthetic construct
  source 1..120: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcaataccgcgccccttctcagttcg

SEQ ID NO: 30853 - RNA, 120 nt, synthetic construct
  source 1..120: mol_type = other RNA
  modified_base 1: mod_base = OTHER; note = 2'-O-methyl guanosine phosphorothioate
  modified_base 2: mod_base = OTHER; note = 2'-O-methyl guanosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl uridine phosphorothioate
  modified_base 119: mod_base = OTHER; note = 2'-O-methyl cytidine phosphorothioate
  modified_base 120: mod_base = OTHER; note = 2'-O-methyl guanosine
gggtcgtagcgaactgagaagttttagagctagaaatagcaagttaaaataaggctagtccgttatcaacttgaaaaagtggcaccgagtcggtgcaataccgcgcccattctcagttcg

SEQ ID NO: 30854 - RNA, 126 nt, synthetic construct; identical to SEQ ID NO: 30544
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl adenosine phosphorothioate
  modified_base 126: mod_base = OTHER; note = 2'-O-methyl guanosine

SEQ ID NO: 30855 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl adenosine phosphorothioate
  modified_base 126: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcttgctgccacaataccgcggcccttctcag

SEQ ID NO: 30856 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl adenosine phosphorothioate
  modified_base 126: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcttgctgccacaatccctcggcccttctcag

SEQ ID NO: 30857 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl adenosine phosphorothioate
  modified_base 126: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcttgctgccacaatcccgcggcccttctcag

SEQ ID NO: 30858 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl adenosine phosphorothioate
  modified_base 126: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcttgctgccacaatacctcgccccttctcag

SEQ ID NO: 30859 - RNA, 126 nt, synthetic construct
  source 1..126: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = uridine phosphorothioate
  modified_base 124: mod_base = OTHER; note = 2'-O-methyl cytidine phosphorothioate
  modified_base 125: mod_base = OTHER; note = 2'-O-methyl adenosine phosphorothioate
  modified_base 126: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcttgctgccacgatacctcggcccttctcag

SEQ ID NO: 30860 - RNA, 124 nt, synthetic construct; identical to SEQ ID NO: 30540
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine

SEQ ID NO: 30861 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcgctgccacaataccgcggcccttctcag

SEQ ID NO: 30862 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcgctgccacaatccctcggcccttctcag

SEQ ID NO: 30863 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcgctgccacaatcccgcggcccttctcag

SEQ ID NO: 30864 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcgctgccacaatacctcgccccttctcag

SEQ ID NO: 30865 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl adenosine phosphorothioate
  modified_base 124: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcgctgccacgatacctcggcccttctcag

SEQ ID NO: 30866 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
tagcgaactgagaagggccagttttagagctagaaatagcaagttaaaataaggctagtccgttatcaacttgaaaaagtggcaccgagtcggtgctgccacaatacctcggcccttctcag

SEQ ID NO: 30867 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
tagcgaactgagaagggccagttttagagctagaaatagcaagttaaaataaggctagtccgttatcaacttgaaaaagtggcaccgagtcggtgctgccacaataccgcggcccttctcag

SEQ ID NO: 30868 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
tagcgaactgagaagggccagttttagagctagaaatagcaagttaaaataaggctagtccgttatcaacttgaaaaagtggcaccgagtcggtgctgccacaatccctcggcccttctcag

SEQ ID NO: 30869 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
tagcgaactgagaagggccagttttagagctagaaatagcaagttaaaataaggctagtccgttatcaacttgaaaaagtggcaccgagtcggtgctgccacaatcccgcggcccttctcag

SEQ ID NO: 30870 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
tagcgaactgagaagggccagttttagagctagaaatagcaagttaaaataaggctagtccgttatcaacttgaaaaagtggcaccgagtcggtgctgccacaatacctcgccccttctcag

SEQ ID NO: 30871 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl adenosine phosphorothioate
  modified_base 122: mod_base = OTHER; note = 2'-O-methyl guanosine
tagcgaactgagaagggccagttttagagctagaaatagcaagttaaaataaggctagtccgttatcaacttgaaaaagtggcaccgagtcggtgctgccacgatacctcggcccttctcag

SEQ ID NO: 30872 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl adenosine phosphorothioate
  modified_base 120: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcccacaatacctcggcccttctcag

SEQ ID NO: 30873 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl adenosine phosphorothioate
  modified_base 120: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcccacaataccgcggcccttctcag

SEQ ID NO: 30874 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl adenosine phosphorothioate
  modified_base 120: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcccacaatccctcggcccttctcag

SEQ ID NO: 30875 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl adenosine phosphorothioate
  modified_base 120: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcccacaatcccgcggcccttctcag

SEQ ID NO: 30876 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl adenosine phosphorothioate
  modified_base 120: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcccacaatacctcgccccttctcag

SEQ ID NO: 30877 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl adenosine phosphorothioate
  modified_base 120: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcccacgatacctcggcccttctcag

SEQ ID NO: 30878 - RNA, 118 nt, synthetic construct; identical to SEQ ID NO: 30492
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine

SEQ ID NO: 30879 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcacaataccgcggcccttctcag

SEQ ID NO: 30880 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcacaatccctcggcccttctcag

SEQ ID NO: 30881 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcacaatcccgcggcccttctcag

SEQ ID NO: 30882 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcacaatacctcgccccttctcag

SEQ ID NO: 30883 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl adenosine phosphorothioate
  modified_base 118: mod_base = OTHER; note = 2'-O-methyl guanosine
tagcgaactgagaagggccagttttagagctagaaatagcaagttaaaataaggctagtccgttatcaacttgaaaaagtggcaccgagtcggtgcacgatacctcggcccttctcag

SEQ ID NO: 30884 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl uridine phosphorothioate
  modified_base 124: mod_base = OTHER; note = 2'-O-methyl cytidine phosphorothioate
  modified_base 125: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcttgctgccacaatacctcggcccttctca

SEQ ID NO: 30885 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl uridine phosphorothioate
  modified_base 124: mod_base = OTHER; note = 2'-O-methyl cytidine phosphorothioate
  modified_base 125: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcttgctgccacaataccgcggcccttctca

SEQ ID NO: 30886 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl uridine phosphorothioate
  modified_base 124: mod_base = OTHER; note = 2'-O-methyl cytidine phosphorothioate
  modified_base 125: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcttgctgccacaatccctcggcccttctca

SEQ ID NO: 30887 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl uridine phosphorothioate
  modified_base 124: mod_base = OTHER; note = 2'-O-methyl cytidine phosphorothioate
  modified_base 125: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcttgctgccacaatcccgcggcccttctca

SEQ ID NO: 30888 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl uridine phosphorothioate
  modified_base 124: mod_base = OTHER; note = 2'-O-methyl cytidine phosphorothioate
  modified_base 125: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcttgctgccacaatacctcgccccttctca

SEQ ID NO: 30889 - RNA, 125 nt, synthetic construct
  source 1..125: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = cytidine phosphorothioate
  modified_base 123: mod_base = OTHER; note = 2'-O-methyl uridine phosphorothioate
  modified_base 124: mod_base = OTHER; note = 2'-O-methyl cytidine phosphorothioate
  modified_base 125: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcttgctgccacgatacctcggcccttctca

SEQ ID NO: 30890 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl cytidine phosphorothioate
  modified_base 123: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcgctgccacaatacctcggcccttctca

SEQ ID NO: 30891 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl cytidine phosphorothioate
  modified_base 123: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcgctgccacaataccgcggcccttctca

SEQ ID NO: 30892 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl cytidine phosphorothioate
  modified_base 123: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcgctgccacaatccctcggcccttctca

SEQ ID NO: 30893 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl cytidine phosphorothioate
  modified_base 123: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcgctgccacaatcccgcggcccttctca

SEQ ID NO: 30894 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl cytidine phosphorothioate
  modified_base 123: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcgctgccacaatacctcgccccttctca

SEQ ID NO: 30895 - RNA, 123 nt, synthetic construct
  source 1..123: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = cytidine phosphorothioate
  modified_base 121: mod_base = OTHER; note = 2'-O-methyl uridine phosphorothioate
  modified_base 122: mod_base = OTHER; note = 2'-O-methyl cytidine phosphorothioate
  modified_base 123: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcgctgccacgatacctcggcccttctca

SEQ ID NO: 30896 - RNA, 121 nt, synthetic construct; identical to SEQ ID NO: 30542
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine

SEQ ID NO: 30897 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine
tagcgaactgagaagggccagttttagagctagaaatagcaagttaaaataaggctagtccgttatcaacttgaaaaagtggcaccgagtcggtgctgccacaataccgcggcccttctca

SEQ ID NO: 30898 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine
tagcgaactgagaagggccagttttagagctagaaatagcaagttaaaataaggctagtccgttatcaacttgaaaaagtggcaccgagtcggtgctgccacaatccctcggcccttctca

SEQ ID NO: 30899 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine
tagcgaactgagaagggccagttttagagctagaaatagcaagttaaaataaggctagtccgttatcaacttgaaaaagtggcaccgagtcggtgctgccacaatcccgcggcccttctca

SEQ ID NO: 30900 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine
tagcgaactgagaagggccagttttagagctagaaatagcaagttaaaataaggctagtccgttatcaacttgaaaaagtggcaccgagtcggtgctgccacaatacctcgccccttctca

SEQ ID NO: 30901 - RNA, 121 nt, synthetic construct
  source 1..121: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = cytidine phosphorothioate
  modified_base 119: mod_base = OTHER; note = 2'-O-methyl uridine phosphorothioate
  modified_base 120: mod_base = OTHER; note = 2'-O-methyl cytidine phosphorothioate
  modified_base 121: mod_base = OTHER; note = 2'-O-methyl adenosine
tagcgaactgagaagggccagttttagagctagaaatagcaagttaaaataaggctagtccgttatcaacttgaaaaagtggcaccgagtcggtgctgccacgatacctcggcccttctca

SEQ ID NO: 30902 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcccacaatacctcggcccttctca

SEQ ID NO: 30903 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcccacaataccgcggcccttctca

SEQ ID NO: 30904 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcccacaatccctcggcccttctca

SEQ ID NO: 30905 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcccacaatcccgcggcccttctca

SEQ ID NO: 30906 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcccacaatacctcgccccttctca

SEQ ID NO: 30907 - RNA, 119 nt, synthetic construct
  source 1..119: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = cytidine phosphorothioate
  modified_base 117: mod_base = OTHER; note = 2'-O-methyl uridine phosphorothioate
  modified_base 118: mod_base = OTHER; note = 2'-O-methyl cytidine phosphorothioate
  modified_base 119: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcccacgatacctcggcccttctca

SEQ ID NO: 30908 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl uridine phosphorothioate
  modified_base 116: mod_base = OTHER; note = 2'-O-methyl cytidine phosphorothioate
  modified_base 117: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcacaatacctcggcccttctca

SEQ ID NO: 30909 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl uridine phosphorothioate
  modified_base 116: mod_base = OTHER; note = 2'-O-methyl cytidine phosphorothioate
  modified_base 117: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcacaataccgcggcccttctca

SEQ ID NO: 30910 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl uridine phosphorothioate
  modified_base 116: mod_base = OTHER; note = 2'-O-methyl cytidine phosphorothioate
  modified_base 117: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcacaatccctcggcccttctca

SEQ ID NO: 30911 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl uridine phosphorothioate
  modified_base 116: mod_base = OTHER; note = 2'-O-methyl cytidine phosphorothioate
  modified_base 117: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcacaatcccgcggcccttctca

SEQ ID NO: 30912 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl uridine phosphorothioate
  modified_base 116: mod_base = OTHER; note = 2'-O-methyl cytidine phosphorothioate
  modified_base 117: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcacaatacctcgccccttctca

SEQ ID NO: 30913 - RNA, 117 nt, synthetic construct
  source 1..117: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = cytidine phosphorothioate
  modified_base 115: mod_base = OTHER; note = 2'-O-methyl uridine phosphorothioate
  modified_base 116: mod_base = OTHER; note = 2'-O-methyl cytidine phosphorothioate
  modified_base 117: mod_base = OTHER; note = 2'-O-methyl adenosine
tagcgaactgagaagggccagttttagagctagaaatagcaagttaaaataaggctagtccgttatcaacttgaaaaagtggcaccgagtcggtgcacgatacctcggcccttctca

SEQ ID NO: 30914 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl uridine phosphorothioate
  modified_base 124: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcttgctgccacaatacctcggcccttctc

SEQ ID NO: 30915 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl uridine phosphorothioate
  modified_base 124: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcttgctgccacaataccgcggcccttctc

SEQ ID NO: 30916 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl uridine phosphorothioate
  modified_base 124: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcttgctgccacaatccctcggcccttctc

SEQ ID NO: 30917 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl uridine phosphorothioate
  modified_base 124: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcttgctgccacaatcccgcggcccttctc

SEQ ID NO: 30918 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl uridine phosphorothioate
  modified_base 124: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcttgctgccacaatacctcgccccttctc

SEQ ID NO: 30919 - RNA, 124 nt, synthetic construct
  source 1..124: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = uridine phosphorothioate
  modified_base 122: mod_base = OTHER; note = 2'-O-methyl cytidine phosphorothioate
  modified_base 123: mod_base = OTHER; note = 2'-O-methyl uridine phosphorothioate
  modified_base 124: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcttgctgccacgatacctcggcccttctc

SEQ ID NO: 30920 - RNA, 122 nt, synthetic construct; identical to SEQ ID NO: 30494
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine

SEQ ID NO: 30921 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcgctgccacaataccgcggcccttctc

SEQ ID NO: 30922 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcgctgccacaatccctcggcccttctc

SEQ ID NO: 30923 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcgctgccacaatcccgcggcccttctc

SEQ ID NO: 30924 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcgctgccacaatacctcgccccttctc

SEQ ID NO: 30925 - RNA, 122 nt, synthetic construct
  source 1..122: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = uridine phosphorothioate
  modified_base 120: mod_base = OTHER; note = 2'-O-methyl cytidine phosphorothioate
  modified_base 121: mod_base = OTHER; note = 2'-O-methyl uridine phosphorothioate
  modified_base 122: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcgctgccacgatacctcggcccttctc

SEQ ID NO: 30926 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl uridine phosphorothioate
  modified_base 120: mod_base = OTHER; note = 2'-O-methyl cytidine
tagcgaactgagaagggccagttttagagctagaaatagcaagttaaaataaggctagtccgttatcaacttgaaaaagtggcaccgagtcggtgctgccacaatacctcggcccttctc

SEQ ID NO: 30927 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl uridine phosphorothioate
  modified_base 120: mod_base = OTHER; note = 2'-O-methyl cytidine
tagcgaactgagaagggccagttttagagctagaaatagcaagttaaaataaggctagtccgttatcaacttgaaaaagtggcaccgagtcggtgctgccacaataccgcggcccttctc

SEQ ID NO: 30928 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl uridine phosphorothioate
  modified_base 120: mod_base = OTHER; note = 2'-O-methyl cytidine
tagcgaactgagaagggccagttttagagctagaaatagcaagttaaaataaggctagtccgttatcaacttgaaaaagtggcaccgagtcggtgctgccacaatccctcggcccttctc

SEQ ID NO: 30929 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl uridine phosphorothioate
  modified_base 120: mod_base = OTHER; note = 2'-O-methyl cytidine
tagcgaactgagaagggccagttttagagctagaaatagcaagttaaaataaggctagtccgttatcaacttgaaaaagtggcaccgagtcggtgctgccacaatcccgcggcccttctc

SEQ ID NO: 30930 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl uridine phosphorothioate
  modified_base 120: mod_base = OTHER; note = 2'-O-methyl cytidine
tagcgaactgagaagggccagttttagagctagaaatagcaagttaaaataaggctagtccgttatcaacttgaaaaagtggcaccgagtcggtgctgccacaatacctcgccccttctc

SEQ ID NO: 30931 - RNA, 120 nt, synthetic construct
  source 1..120: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = uridine phosphorothioate
  modified_base 118: mod_base = OTHER; note = 2'-O-methyl cytidine phosphorothioate
  modified_base 119: mod_base = OTHER; note = 2'-O-methyl uridine phosphorothioate
  modified_base 120: mod_base = OTHER; note = 2'-O-methyl cytidine
tagcgaactgagaagggccagttttagagctagaaatagcaagttaaaataaggctagtccgttatcaacttgaaaaagtggcaccgagtcggtgctgccacgatacctcggcccttctc

SEQ ID NO: 30932 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl uridine phosphorothioate
  modified_base 118: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcccacaatacctcggcccttctc

SEQ ID NO: 30933 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl uridine phosphorothioate
  modified_base 118: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcccacaataccgcggcccttctc

SEQ ID NO: 30934 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl uridine phosphorothioate
  modified_base 118: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcccacaatccctcggcccttctc

SEQ ID NO: 30935 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl uridine phosphorothioate
  modified_base 118: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcccacaatcccgcggcccttctc

SEQ ID NO: 30936 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl uridine phosphorothioate
  modified_base 118: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcccacaatacctcgccccttctc

SEQ ID NO: 30937 - RNA, 118 nt, synthetic construct
  source 1..118: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = uridine phosphorothioate
  modified_base 116: mod_base = OTHER; note = 2'-O-methyl cytidine phosphorothioate
  modified_base 117: mod_base = OTHER; note = 2'-O-methyl uridine phosphorothioate
  modified_base 118: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcccacgatacctcggcccttctc

SEQ ID NO: 30938 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl uridine phosphorothioate
  modified_base 116: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcacaatacctcggcccttctc

SEQ ID NO: 30939 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl uridine phosphorothioate
  modified_base 116: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcacaataccgcggcccttctc

SEQ ID NO: 30940 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl uridine phosphorothioate
  modified_base 116: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcacaatccctcggcccttctc

SEQ ID NO: 30941 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl uridine phosphorothioate
  modified_base 116: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcacaatcccgcggcccttctc

SEQ ID NO: 30942 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl uridine phosphorothioate
  modified_base 116: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcacaatacctcgccccttctc

SEQ ID NO: 30943 - RNA, 116 nt, synthetic construct
  source 1..116: mol_type = other RNA
  modified_base 1: mod_base = OTHER; note = 2'-O-methyl uridine phosphorothioate
  modified_base 2: mod_base = OTHER; note = 2'-O-methyl adenosine phosphorothioate
  modified_base 3: mod_base = OTHER; note = 2'-O-methyl guanosine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 113: mod_base = OTHER; note = uridine phosphorothioate
  modified_base 114: mod_base = OTHER; note = 2'-O-methyl cytidine phosphorothioate
  modified_base 115: mod_base = OTHER; note = 2'-O-methyl uridine phosphorothioate
  modified_base 116: mod_base = OTHER; note = 2'-O-methyl cytidine
tagcgaactgagaagggccagttttagagctagaaatagcaagttaaaataaggctagtccgttatcaacttgaaaaagtggcaccgagtcggtgcacgatacctcggcccttctc

SEQ ID NO: 30944 - RNA, 127 nt, synthetic construct
  source 1..127: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl adenosine phosphorothioate
  modified_base 127: mod_base = OTHER; note = 2'-O-methyl guanosine
actttgctgccacaatacctgttttagagctagaaatagcaagttaaaataaggctagtccgttatcaacttgaaaaagtggcaccgagtcggtgccgaactgagaagggccgaggtattgtggcag

SEQ ID NO: 30945 - RNA, 127 nt, synthetic construct
  source 1..127: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl adenosine phosphorothioate
  modified_base 127: mod_base = OTHER; note = 2'-O-methyl guanosine
actttgctgccacaatacctgttttagagctagaaatagcaagttaaaataaggctagtccgttatcaacttgaaaaagtggcaccgagtcggtgccgaactgagaagggccggggtattgtggcag

SEQ ID NO: 30946 - RNA, 127 nt, synthetic construct
  source 1..127: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl adenosine phosphorothioate
  modified_base 127: mod_base = OTHER; note = 2'-O-methyl guanosine
actttgctgccacaatacctgttttagagctagaaatagcaagttaaaataaggctagtccgttatcaacttgaaaaagtggcaccgagtcggtgccgaactgagaacggccggggtattgtggcag

SEQ ID NO: 30947 - RNA, 127 nt, synthetic construct
  source 1..127: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl adenosine phosphorothioate
  modified_base 127: mod_base = OTHER; note = 2'-O-methyl guanosine
actttgctgccacaatacctgttttagagctagaaatagcaagttaaaataaggctagtccgttatcaacttgaaaaagtggcaccgagtcggtgccgaactgagaacggacggggtattgtggcag

SEQ ID NO: 30948 - RNA, 127 nt, synthetic construct
  source 1..127: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl adenosine phosphorothioate
  modified_base 127: mod_base = OTHER; note = 2'-O-methyl guanosine
actttgctgccacaatacctgttttagagctagaaatagcaagttaaaataaggctagtccgttatcaacttgaaaaagtggcaccgagtcggtgccgaactgagaagggccgcggtattgtggcag

SEQ ID NO: 30949 - RNA, 127 nt, synthetic construct
  source 1..127: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 124: mod_base = OTHER; note = guanosine phosphorothioate
  modified_base 125: mod_base = OTHER; note = 2'-O-methyl cytidine phosphorothioate
  modified_base 126: mod_base = OTHER; note = 2'-O-methyl adenosine phosphorothioate
  modified_base 127: mod_base = OTHER; note = 2'-O-methyl guanosine
actttgctgccacaatacctgttttagagctagaaatagcaagttaaaataaggctagtccgttatcaacttgaaaaagtggcaccgagtcggtgccgaactgagaagggacgcggtattgtggcag

SEQ ID NO: 30950 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaactgagaagggccgaggtattgtggcag

SEQ ID NO: 30951 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaactgagaagggccggggtattgtggcag

SEQ ID NO: 30952 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaactgagaacggccggggtattgtggcag

SEQ ID NO: 30953 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaactgagaacggacggggtattgtggcag

SEQ ID NO: 30954 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaactgagaagggccgcggtattgtggcag

SEQ ID NO: 30955 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = guanosine phosphorothioate
  modified_base 123: mod_base = OTHER; note = 2'-O-methyl cytidine phosphorothioate
  modified_base 124: mod_base = OTHER; note = 2'-O-methyl adenosine phosphorothioate
  modified_base 125: mod_base = OTHER; note = 2'-O-methyl guanosine
actttgctgccacaatacctgttttagagctagaaatagcaagttaaaataaggctagtccgttatcaacttgaaaaagtggcaccgagtcggtgcaactgagaagggacgcggtattgtggcag

SEQ ID NO: 30956 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine
actttgctgccacaatacctgttttagagctagaaatagcaagttaaaataaggctagtccgttatcaacttgaaaaagtggcaccgagtcggtgcctgagaagggccgaggtattgtggcag

SEQ ID NO: 30957 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine
actttgctgccacaatacctgttttagagctagaaatagcaagttaaaataaggctagtccgttatcaacttgaaaaagtggcaccgagtcggtgcctgagaagggccggggtattgtggcag

SEQ ID NO: 30958 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine
actttgctgccacaatacctgttttagagctagaaatagcaagttaaaataaggctagtccgttatcaacttgaaaaagtggcaccgagtcggtgcctgagaacggccggggtattgtggcag

SEQ ID NO: 30959 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine
actttgctgccacaatacctgttttagagctagaaatagcaagttaaaataaggctagtccgttatcaacttgaaaaagtggcaccgagtcggtgcctgagaacggacggggtattgtggcag

SEQ ID NO: 30960 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine
actttgctgccacaatacctgttttagagctagaaatagcaagttaaaataaggctagtccgttatcaacttgaaaaagtggcaccgagtcggtgcctgagaagggccgcggtattgtggcag

SEQ ID NO: 30961 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = guanosine phosphorothioate
  modified_base 121: mod_base = OTHER; note = 2'-O-methyl cytidine phosphorothioate
  modified_base 122: mod_base = OTHER; note = 2'-O-methyl adenosine phosphorothioate
  modified_base 123: mod_base = OTHER; note = 2'-O-methyl guanosine
actttgctgccacaatacctgttttagagctagaaatagcaagttaaaataaggctagtccgttatcaacttgaaaaagtggcaccgagtcggtgcctgagaagggacgcggtattgtggcag

SEQ ID NO: 30962 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgagaagggccgaggtattgtggcag

SEQ ID NO: 30963 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgagaagggccggggtattgtggcag

SEQ ID NO: 30964 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgagaacggccggggtattgtggcag

SEQ ID NO: 30965 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgagaacggacggggtattgtggcag

SEQ ID NO: 30966 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgagaagggccgcggtattgtggcag

SEQ ID NO: 30967 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = guanosine phosphorothioate
  modified_base 119: mod_base = OTHER; note = 2'-O-methyl cytidine phosphorothioate
  modified_base 120: mod_base = OTHER; note = 2'-O-methyl adenosine phosphorothioate
  modified_base 121: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgagaagggacgcggtattgtggcag

SEQ ID NO: 30968 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgaagggccgaggtattgtggcag

SEQ ID NO: 30969 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgaagggccggggtattgtggcag

SEQ ID NO: 30970 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgaacggccggggtattgtggcag

SEQ ID NO: 30971 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgaacggacggggtattgtggcag

SEQ ID NO: 30972 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgaagggccgcggtattgtggcag

SEQ ID NO: 30973 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = guanosine phosphorothioate
  modified_base 117: mod_base = OTHER; note = 2'-O-methyl cytidine phosphorothioate
  modified_base 118: mod_base = OTHER; note = 2'-O-methyl adenosine phosphorothioate
  modified_base 119: mod_base = OTHER; note = 2'-O-methyl guanosine
actttgctgccacaatacctgttttagagctagaaatagcaagttaaaataaggctagtccgttatcaacttgaaaaagtggcaccgagtcggtgcgaagggacgcggtattgtggcag

SEQ ID NO: 30974 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = guanosine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl adenosine
actttgctgccacaatacctgttttagagctagaaatagcaagttaaaataaggctagtccgttatcaacttgaaaaagtggcaccgagtcggtgccgaactgagaagggccgaggtattgtggca

SEQ ID NO: 30975 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = guanosine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl adenosine
actttgctgccacaatacctgttttagagctagaaatagcaagttaaaataaggctagtccgttatcaacttgaaaaagtggcaccgagtcggtgccgaactgagaagggccggggtattgtggca

SEQ ID NO: 30976 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = guanosine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl adenosine
actttgctgccacaatacctgttttagagctagaaatagcaagttaaaataaggctagtccgttatcaacttgaaaaagtggcaccgagtcggtgccgaactgagaacggccggggtattgtggca

SEQ ID NO: 30977 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = guanosine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl adenosine
actttgctgccacaatacctgttttagagctagaaatagcaagttaaaataaggctagtccgttatcaacttgaaaaagtggcaccgagtcggtgccgaactgagaacggacggggtattgtggca

SEQ ID NO: 30978 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = guanosine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl adenosine
actttgctgccacaatacctgttttagagctagaaatagcaagttaaaataaggctagtccgttatcaacttgaaaaagtggcaccgagtcggtgccgaactgagaagggccgcggtattgtggca

SEQ ID NO: 30979 - RNA, 126 nt, synthetic construct
  source 1..126: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 123: mod_base = OTHER; note = guanosine phosphorothioate
  modified_base 124: mod_base = OTHER; note = 2'-O-methyl guanosine phosphorothioate
  modified_base 125: mod_base = OTHER; note = 2'-O-methyl cytidine phosphorothioate
  modified_base 126: mod_base = OTHER; note = 2'-O-methyl adenosine
actttgctgccacaatacctgttttagagctagaaatagcaagttaaaataaggctagtccgttatcaacttgaaaaagtggcaccgagtcggtgccgaactgagaagggacgcggtattgtggca

SEQ ID NO: 30980 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaactgagaagggccgaggtattgtggca

SEQ ID NO: 30981 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaactgagaagggccggggtattgtggca

SEQ ID NO: 30982 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaactgagaacggccggggtattgtggca

SEQ ID NO: 30983 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaactgagaacggacggggtattgtggca

SEQ ID NO: 30984 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaactgagaagggccgcggtattgtggca

SEQ ID NO: 30985 - RNA, 124 nt, synthetic construct
  source 1..124: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 121: mod_base = OTHER; note = guanosine phosphorothioate
  modified_base 122: mod_base = OTHER; note = 2'-O-methyl guanosine phosphorothioate
  modified_base 123: mod_base = OTHER; note = 2'-O-methyl cytidine phosphorothioate
  modified_base 124: mod_base = OTHER; note = 2'-O-methyl adenosine
actttgctgccacaatacctgttttagagctagaaatagcaagttaaaataaggctagtccgttatcaacttgaaaaagtggcaccgagtcggtgcaactgagaagggacgcggtattgtggca

SEQ ID NO: 30986 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcctgagaagggccgaggtattgtggca

SEQ ID NO: 30987 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcctgagaagggccggggtattgtggca

SEQ ID NO: 30988 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcctgagaacggccggggtattgtggca

SEQ ID NO: 30989 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcctgagaacggacggggtattgtggca

SEQ ID NO: 30990 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcctgagaagggccgcggtattgtggca

SEQ ID NO: 30991 - RNA, 122 nt, synthetic construct
  source 1..122: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 119: mod_base = OTHER; note = guanosine phosphorothioate
  modified_base 120: mod_base = OTHER; note = 2'-O-methyl guanosine phosphorothioate
  modified_base 121: mod_base = OTHER; note = 2'-O-methyl cytidine phosphorothioate
  modified_base 122: mod_base = OTHER; note = 2'-O-methyl adenosine
actttgctgccacaatacctgttttagagctagaaatagcaagttaaaataaggctagtccgttatcaacttgaaaaagtggcaccgagtcggtgcctgagaagggacgcggtattgtggca

SEQ ID NO: 30992 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = guanosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgagaagggccgaggtattgtggca

SEQ ID NO: 30993 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = guanosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgagaagggccggggtattgtggca

SEQ ID NO: 30994 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = guanosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgagaacggccggggtattgtggca

SEQ ID NO: 30995 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = guanosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgagaacggacggggtattgtggca

SEQ ID NO: 30996 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = guanosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgagaagggccgcggtattgtggca

SEQ ID NO: 30997 - RNA, 120 nt, synthetic construct
  source 1..120: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 117: mod_base = OTHER; note = guanosine phosphorothioate
  modified_base 118: mod_base = OTHER; note = 2'-O-methyl guanosine phosphorothioate
  modified_base 119: mod_base = OTHER; note = 2'-O-methyl cytidine phosphorothioate
  modified_base 120: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgagaagggacgcggtattgtggca

SEQ ID NO: 30998 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl guanosine phosphorothioate
  modified_base 117: mod_base = OTHER; note = 2'-O-methyl cytidine phosphorothioate
  modified_base 118: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgaagggccgaggtattgtggca

SEQ ID NO: 30999 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl guanosine phosphorothioate
  modified_base 117: mod_base = OTHER; note = 2'-O-methyl cytidine phosphorothioate
  modified_base 118: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgaagggccggggtattgtggca

SEQ ID NO: 31000 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl guanosine phosphorothioate
  modified_base 117: mod_base = OTHER; note = 2'-O-methyl cytidine phosphorothioate
  modified_base 118: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgaacggccggggtattgtggca

SEQ ID NO: 31001 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl guanosine phosphorothioate
  modified_base 117: mod_base = OTHER; note = 2'-O-methyl cytidine phosphorothioate
  modified_base 118: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgaacggacggggtattgtggca

SEQ ID NO: 31002 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl guanosine phosphorothioate
  modified_base 117: mod_base = OTHER; note = 2'-O-methyl cytidine phosphorothioate
  modified_base 118: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgaagggccgcggtattgtggca

SEQ ID NO: 31003 - RNA, 118 nt, synthetic construct
  source 1..118: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 115: mod_base = OTHER; note = guanosine phosphorothioate
  modified_base 116: mod_base = OTHER; note = 2'-O-methyl guanosine phosphorothioate
  modified_base 117: mod_base = OTHER; note = 2'-O-methyl cytidine phosphorothioate
  modified_base 118: mod_base = OTHER; note = 2'-O-methyl adenosine
actttgctgccacaatacctgttttagagctagaaatagcaagttaaaataaggctagtccgttatcaacttgaaaaagtggcaccgagtcggtgcgaagggacgcggtattgtggca

SEQ ID NO: 31004 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl guanosine phosphorothioate
  modified_base 124: mod_base = OTHER; note = 2'-O-methyl guanosine phosphorothioate
  modified_base 125: mod_base = OTHER; note = 2'-O-methyl cytidine
actttgctgccacaatacctgttttagagctagaaatagcaagttaaaataaggctagtccgttatcaacttgaaaaagtggcaccgagtcggtgccgaactgagaagggccgaggtattgtggc

SEQ ID NO: 31005 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl guanosine phosphorothioate
  modified_base 124: mod_base = OTHER; note = 2'-O-methyl guanosine phosphorothioate
  modified_base 125: mod_base = OTHER; note = 2'-O-methyl cytidine
actttgctgccacaatacctgttttagagctagaaatagcaagttaaaataaggctagtccgttatcaacttgaaaaagtggcaccgagtcggtgccgaactgagaagggccggggtattgtggc

SEQ ID NO: 31006 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl guanosine phosphorothioate
  modified_base 124: mod_base = OTHER; note = 2'-O-methyl guanosine phosphorothioate
  modified_base 125: mod_base = OTHER; note = 2'-O-methyl cytidine
actttgctgccacaatacctgttttagagctagaaatagcaagttaaaataaggctagtccgttatcaacttgaaaaagtggcaccgagtcggtgccgaactgagaacggccggggtattgtggc

SEQ ID NO: 31007 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl guanosine phosphorothioate
  modified_base 124: mod_base = OTHER; note = 2'-O-methyl guanosine phosphorothioate
  modified_base 125: mod_base = OTHER; note = 2'-O-methyl cytidine
actttgctgccacaatacctgttttagagctagaaatagcaagttaaaataaggctagtccgttatcaacttgaaaaagtggcaccgagtcggtgccgaactgagaacggacggggtattgtggc

SEQ ID NO: 31008 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl guanosine phosphorothioate
  modified_base 124: mod_base = OTHER; note = 2'-O-methyl guanosine phosphorothioate
  modified_base 125: mod_base = OTHER; note = 2'-O-methyl cytidine
actttgctgccacaatacctgttttagagctagaaatagcaagttaaaataaggctagtccgttatcaacttgaaaaagtggcaccgagtcggtgccgaactgagaagggccgcggtattgtggc

SEQ ID NO: 31009 - RNA, 125 nt, synthetic construct
  source 1..125: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 122: mod_base = OTHER; note = uridine phosphorothioate
  modified_base 123: mod_base = OTHER; note = 2'-O-methyl guanosine phosphorothioate
  modified_base 124: mod_base = OTHER; note = 2'-O-methyl guanosine phosphorothioate
  modified_base 125: mod_base = OTHER; note = 2'-O-methyl cytidine
actttgctgccacaatacctgttttagagctagaaatagcaagttaaaataaggctagtccgttatcaacttgaaaaagtggcaccgagtcggtgccgaactgagaagggacgcggtattgtggc

SEQ ID NO: 31010 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl guanosine phosphorothioate
  modified_base 122: mod_base = OTHER; note = 2'-O-methyl guanosine phosphorothioate
  modified_base 123: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaactgagaagggccgaggtattgtggc

SEQ ID NO: 31011 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl guanosine phosphorothioate
  modified_base 122: mod_base = OTHER; note = 2'-O-methyl guanosine phosphorothioate
  modified_base 123: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaactgagaagggccggggtattgtggc

SEQ ID NO: 31012 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl guanosine phosphorothioate
  modified_base 122: mod_base = OTHER; note = 2'-O-methyl guanosine phosphorothioate
  modified_base 123: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaactgagaacggccggggtattgtggc

SEQ ID NO: 31013 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl guanosine phosphorothioate
  modified_base 122: mod_base = OTHER; note = 2'-O-methyl guanosine phosphorothioate
  modified_base 123: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaactgagaacggacggggtattgtggc

SEQ ID NO: 31014 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl guanosine phosphorothioate
  modified_base 122: mod_base = OTHER; note = 2'-O-methyl guanosine phosphorothioate
  modified_base 123: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaactgagaagggccgcggtattgtggc

SEQ ID NO: 31015 - RNA, 123 nt, synthetic construct
  source 1..123: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 120: mod_base = OTHER; note = uridine phosphorothioate
  modified_base 121: mod_base = OTHER; note = 2'-O-methyl guanosine phosphorothioate
  modified_base 122: mod_base = OTHER; note = 2'-O-methyl guanosine phosphorothioate
  modified_base 123: mod_base = OTHER; note = 2'-O-methyl cytidine
actttgctgccacaatacctgttttagagctagaaatagcaagttaaaataaggctagtccgttatcaacttgaaaaagtggcaccgagtcggtgcaactgagaagggacgcggtattgtggc

SEQ ID NO: 31016 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl guanosine phosphorothioate
  modified_base 120: mod_base = OTHER; note = 2'-O-methyl guanosine phosphorothioate
  modified_base 121: mod_base = OTHER; note = 2'-O-methyl cytidine
actttgctgccacaatacctgttttagagctagaaatagcaagttaaaataaggctagtccgttatcaacttgaaaaagtggcaccgagtcggtgcctgagaagggccgaggtattgtggc

SEQ ID NO: 31017 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl guanosine phosphorothioate
  modified_base 120: mod_base = OTHER; note = 2'-O-methyl guanosine phosphorothioate
  modified_base 121: mod_base = OTHER; note = 2'-O-methyl cytidine
actttgctgccacaatacctgttttagagctagaaatagcaagttaaaataaggctagtccgttatcaacttgaaaaagtggcaccgagtcggtgcctgagaagggccggggtattgtggc

SEQ ID NO: 31018 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl guanosine phosphorothioate
  modified_base 120: mod_base = OTHER; note = 2'-O-methyl guanosine phosphorothioate
  modified_base 121: mod_base = OTHER; note = 2'-O-methyl cytidine
actttgctgccacaatacctgttttagagctagaaatagcaagttaaaataaggctagtccgttatcaacttgaaaaagtggcaccgagtcggtgcctgagaacggccggggtattgtggc

SEQ ID NO: 31019 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl guanosine phosphorothioate
  modified_base 120: mod_base = OTHER; note = 2'-O-methyl guanosine phosphorothioate
  modified_base 121: mod_base = OTHER; note = 2'-O-methyl cytidine
actttgctgccacaatacctgttttagagctagaaatagcaagttaaaataaggctagtccgttatcaacttgaaaaagtggcaccgagtcggtgcctgagaacggacggggtattgtggc

SEQ ID NO: 31020 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl guanosine phosphorothioate
  modified_base 120: mod_base = OTHER; note = 2'-O-methyl guanosine phosphorothioate
  modified_base 121: mod_base = OTHER; note = 2'-O-methyl cytidine
actttgctgccacaatacctgttttagagctagaaatagcaagttaaaataaggctagtccgttatcaacttgaaaaagtggcaccgagtcggtgcctgagaagggccgcggtattgtggc

SEQ ID NO: 31021 - RNA, 121 nt, synthetic construct
  source 1..121: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 118: mod_base = OTHER; note = uridine phosphorothioate
  modified_base 119: mod_base = OTHER; note = 2'-O-methyl guanosine phosphorothioate
  modified_base 120: mod_base = OTHER; note = 2'-O-methyl guanosine phosphorothioate
  modified_base 121: mod_base = OTHER; note = 2'-O-methyl cytidine
actttgctgccacaatacctgttttagagctagaaatagcaagttaaaataaggctagtccgttatcaacttgaaaaagtggcaccgagtcggtgcctgagaagggacgcggtattgtggc

SEQ ID NO: 31022 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl guanosine phosphorothioate
  modified_base 118: mod_base = OTHER; note = 2'-O-methyl guanosine phosphorothioate
  modified_base 119: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgagaagggccgaggtattgtggc

SEQ ID NO: 31023 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl guanosine phosphorothioate
  modified_base 118: mod_base = OTHER; note = 2'-O-methyl guanosine phosphorothioate
  modified_base 119: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgagaagggccggggtattgtggc

SEQ ID NO: 31024 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl guanosine phosphorothioate
  modified_base 118: mod_base = OTHER; note = 2'-O-methyl guanosine phosphorothioate
  modified_base 119: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgagaacggccggggtattgtggc

SEQ ID NO: 31025 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl guanosine phosphorothioate
  modified_base 118: mod_base = OTHER; note = 2'-O-methyl guanosine phosphorothioate
  modified_base 119: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgagaacggacggggtattgtggc

SEQ ID NO: 31026 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl guanosine phosphorothioate
  modified_base 118: mod_base = OTHER; note = 2'-O-methyl guanosine phosphorothioate
  modified_base 119: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgagaagggccgcggtattgtggc

SEQ ID NO: 31027 - RNA, 119 nt, synthetic construct
  source 1..119: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 116: mod_base = OTHER; note = uridine phosphorothioate
  modified_base 117: mod_base = OTHER; note = 2'-O-methyl guanosine phosphorothioate
  modified_base 118: mod_base = OTHER; note = 2'-O-methyl guanosine phosphorothioate
  modified_base 119: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgagaagggacgcggtattgtggc

SEQ ID NO: 31028 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = uridine phosphorothioate
  modified_base 115: mod_base = OTHER; note = 2'-O-methyl guanosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgaagggccgaggtattgtggc

SEQ ID NO: 31029 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = uridine phosphorothioate
  modified_base 115: mod_base = OTHER; note = 2'-O-methyl guanosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgaagggccggggtattgtggc

SEQ ID NO: 31030 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = uridine phosphorothioate
  modified_base 115: mod_base = OTHER; note = 2'-O-methyl guanosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgaacggccggggtattgtggc

SEQ ID NO: 31031 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = uridine phosphorothioate
  modified_base 115: mod_base = OTHER; note = 2'-O-methyl guanosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgaacggacggggtattgtggc

SEQ ID NO: 31032 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = uridine phosphorothioate
  modified_base 115: mod_base = OTHER; note = 2'-O-methyl guanosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgaagggccgcggtattgtggc

SEQ ID NO: 31033 - RNA, 117 nt, synthetic construct
  source 1..117: mol_type = other RNA
  modified_base 1: mod_base = OTHER; note = 2'-O-methyl adenosine phosphorothioate
  modified_base 2: mod_base = OTHER; note = 2'-O-methyl cytidine phosphorothioate
  modified_base 3: mod_base = OTHER; note = 2'-O-methyl uridine phosphorothioate
  modified_base 29: mod_base = OTHER; note = 2'-O-methyl guanosine
  modified_base 30: mod_base = OTHER; note = 2'-O-methyl cytidine
  modified_base 31: mod_base = OTHER; note = 2'-O-methyl uridine
  modified_base 32: mod_base = OTHER; note = 2'-O-methyl adenosine
  modified_base 33: mod_base = OTHER; note = 2'-O-methyl guanosine
  modified_base 34: mod_base = OTHER; note = 2'-O-methyl adenosine
  modified_base 35: mod_base = OTHER; note = 2'-O-methyl adenosine
  modified_base 36: mod_base = OTHER; note = 2'-O-methyl adenosine
  modified_base 37: mod_base = OTHER; note = 2'-O-methyl uridine
  modified_base 38: mod_base = OTHER; note = 2'-O-methyl adenosine
  modified_base 39: mod_base = OTHER; note = 2'-O-methyl guanosine
  modified_base 40: mod_base = OTHER; note = 2'-O-methyl cytidine
  modified_base 69: mod_base = OTHER; note = 2'-O-methyl adenosine
  modified_base 70: mod_base = OTHER; note = 2'-O-methyl cytidine
  modified_base 71: mod_base = OTHER; note = 2'-O-methyl uridine
  modified_base 72: mod_base = OTHER; note = 2'-O-methyl uridine
  modified_base 73: mod_base = OTHER; note = 2'-O-methyl guanosine
  modified_base 74: mod_base = OTHER; note = 2'-O-methyl adenosine
  modified_base 75: mod_base = OTHER; note = 2'-O-methyl adenosine
  modified_base 76: mod_base = OTHER; note = 2'-O-methyl adenosine
  modified_base 77: mod_base = OTHER; note = 2'-O-methyl adenosine
  modified_base 78: mod_base = OTHER; note = 2'-O-methyl adenosine
  modified_base 79: mod_base = OTHER; note = 2'-O-methyl guanosine
  modified_base 80: mod_base = OTHER; note = 2'-O-methyl uridine
  modified_base 81: mod_base = OTHER; note = 2'-O-methyl guanosine
  modified_base 82: mod_base = OTHER; note = 2'-O-methyl guanosine
  modified_base 83: mod_base = OTHER; note = 2'-O-methyl cytidine
  modified_base 84: mod_base = OTHER; note = 2'-O-methyl adenosine
  modified_base 85: mod_base = OTHER; note = 2'-O-methyl cytidine
  modified_base 86: mod_base = OTHER; note = 2'-O-methyl cytidine
  modified_base 87: mod_base = OTHER; note = 2'-O-methyl guanosine
  modified_base 88: mod_base = OTHER; note = 2'-O-methyl adenosine
  modified_base 89: mod_base = OTHER; note = 2'-O-methyl guanosine
  modified_base 90: mod_base = OTHER; note = 2'-O-methyl uridine
  modified_base 91: mod_base = OTHER; note = 2'-O-methyl cytidine
  modified_base 92: mod_base = OTHER; note = 2'-O-methyl guanosine
  modified_base 93: mod_base = OTHER; note = 2'-O-methyl guanosine
  modified_base 94: mod_base = OTHER; note = 2'-O-methyl uridine
  modified_base 95: mod_base = OTHER; note = 2'-O-methyl guanosine
  modified_base 96: mod_base = OTHER; note = 2'-O-methyl cytidine
  modified_base 114: mod_base = OTHER; note = uridine phosphorothioate
  modified_base 115: mod_base = OTHER; note = 2'-O-methyl guanosine phosphorothioate
  modified_base 116: mod_base = OTHER; note = 2'-O-methyl guanosine phosphorothioate
  modified_base 117: mod_base = OTHER; note = 2'-O-methyl cytidine
actttgctgccacaatacctgttttagagctagaaatagcaagttaaaataaggctagtccgttatcaacttgaaaaagtggcaccgagtcggtgcgaagggacgcggtattgtggc

SEQ ID NO: 31034 - DNA, 126 bp, synthetic construct
  source 1..126: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatac

SEQ ID NO: 31035 - DNA, 127 bp, synthetic construct
  source 1..127: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatac

SEQ ID NO: 31036 - DNA, 128 bp, synthetic construct
  source 1..128: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatac

SEQ ID NO: 31037 - DNA, 129 bp, synthetic construct
  source 1..129: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatac

SEQ ID NO: 31038 - DNA, 130 bp, synthetic construct
  source 1..130: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatac

SEQ ID NO: 31039 - DNA, 131 bp, synthetic construct
  source 1..131: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatac

SEQ ID NO: 31040 - DNA, 132 bp, synthetic construct
  source 1..132: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatac

SEQ ID NO: 31041 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatac

SEQ ID NO: 31042 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatac

SEQ ID NO: 31043 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatac

SEQ ID NO: 31044 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatac

SEQ ID NO: 31045 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatac

SEQ ID NO: 31046 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatac

SEQ ID NO: 31047 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatac

SEQ ID NO: 31048 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatac

SEQ ID NO: 31049 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatac

SEQ ID NO: 31050 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatac

SEQ ID NO: 31051 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatac

SEQ ID NO: 31052 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatac

SEQ ID NO: 31053 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatac

SEQ ID NO: 31054 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatac

SEQ ID NO: 31055 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatac

SEQ ID NO: 31056 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatac

SEQ ID NO: 31057 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatac

SEQ ID NO: 31058 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatac

SEQ ID NO: 31059 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatac

SEQ ID NO: 31060 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatac

SEQ ID NO: 31061 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatac

SEQ ID NO: 31062 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatac

SEQ ID NO: 31063 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatac

SEQ ID NO: 31064 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatac

SEQ ID NO: 31065 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatac

SEQ ID NO: 31066 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatac

SEQ ID NO: 31067 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatac

SEQ ID NO: 31068 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatac

SEQ ID NO: 31069 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatac

SEQ ID NO: 31070 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatac

SEQ ID NO: 31071 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatac

SEQ ID NO: 31072 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatac

SEQ ID NO: 31073 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatac

SEQ ID NO: 31074 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatac

SEQ ID NO: 31075 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatac

SEQ ID NO: 31076 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatac

SEQ ID NO: 31077 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatac

SEQ ID NO: 31078 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatac

SEQ ID NO: 31079 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatac

SEQ ID NO: 31080 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatac

SEQ ID NO: 31081 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatac

SEQ ID NO: 31082 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatac

SEQ ID NO: 31083 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatac

SEQ ID NO: 31084 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatac

SEQ ID NO: 31085 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaagga

SEQ ID NO: 31086 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaagga

SEQ ID NO: 31087 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaagga

SEQ ID NO: 31088 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaagga

SEQ ID NO: 31089 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaagga

SEQ ID NO: 31090 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaagga

SEQ ID NO: 31091 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaagga

SEQ ID NO: 31092 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaagga

SEQ ID NO: 31093 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaagga

SEQ ID NO: 31094 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaagga

SEQ ID NO: 31095 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaagga

SEQ ID NO: 31096 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaagga

SEQ ID NO: 31097 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaagga

SEQ ID NO: 31098 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaagga

SEQ ID NO: 31099 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaagga

SEQ ID NO: 31100 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaagga

SEQ ID NO: 31101 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaagga

SEQ ID NO: 31102 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaagga

SEQ ID NO: 31103 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaagga

SEQ ID NO: 31104 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaagga

SEQ ID NO: 31105 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaagga

SEQ ID NO: 31106 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaagga

SEQ ID NO: 31107 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaagga

SEQ ID NO: 31108 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaagga

SEQ ID NO: 31109 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaagga

SEQ ID NO: 31110 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaagga

SEQ ID NO: 31111 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaagga

SEQ ID NO: 31112 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaagga

SEQ ID NO: 31113 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaagga

SEQ ID NO: 31114 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaagga

SEQ ID NO: 31115 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaagga

SEQ ID NO: 31116 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaagga

SEQ ID NO: 31117 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaagga

SEQ ID NO: 31118 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaagga

SEQ ID NO: 31119 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaagga

SEQ ID NO: 31120 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaagga

SEQ ID NO: 31121 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaagga

SEQ ID NO: 31122 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaagga

SEQ ID NO: 31123 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaagga

SEQ ID NO: 31124 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaagga

SEQ ID NO: 31125 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaagga

SEQ ID NO: 31126 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaagga

SEQ ID NO: 31127 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaagga

SEQ ID NO: 31128 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaagga

SEQ ID NO: 31129 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaagga

SEQ ID NO: 31130 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaagga

SEQ ID NO: 31131 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaagga

SEQ ID NO: 31132 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaagga

SEQ ID NO: 31133 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaagga

SEQ ID NO: 31134 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaagga

SEQ ID NO: 31135 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaagga

SEQ ID NO: 31136 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaaggat

SEQ ID NO: 31137 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaaggat

SEQ ID NO: 31138 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaaggat

SEQ ID NO: 31139 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaaggat

SEQ ID NO: 31140 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaaggat

SEQ ID NO: 31141 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaaggat

SEQ ID NO: 31142 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaaggat

SEQ ID NO: 31143 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaaggat

SEQ ID NO: 31144 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaaggat

SEQ ID NO: 31145 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaaggat

SEQ ID NO: 31146 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaaggat

SEQ ID NO: 31147 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaaggat

SEQ ID NO: 31148 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaaggat

SEQ ID NO: 31149 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaaggat

SEQ ID NO: 31150 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaaggat

SEQ ID NO: 31151 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaaggat

SEQ ID NO: 31152 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaaggat

SEQ ID NO: 31153 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaaggat

SEQ ID NO: 31154 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaaggat

SEQ ID NO: 31155 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaaggat

SEQ ID NO: 31156 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaaggat

SEQ ID NO: 31157 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaaggat

SEQ ID NO: 31158 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaaggat

SEQ ID NO: 31159 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaaggat

SEQ ID NO: 31160 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaaggat

SEQ ID NO: 31161 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaaggat

SEQ ID NO: 31162 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaaggat

SEQ ID NO: 31163 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaaggat

SEQ ID NO: 31164 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggat

SEQ ID NO: 31165 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggat

SEQ ID NO: 31166 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggat

SEQ ID NO: 31167 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggat

SEQ ID NO: 31168 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggat

SEQ ID NO: 31169 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggat

SEQ ID NO: 31170 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggat

SEQ ID NO: 31171 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggat

SEQ ID NO: 31172 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggat

SEQ ID NO: 31173 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggat

SEQ ID NO: 31174 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggat

SEQ ID NO: 31175 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggat

SEQ ID NO: 31176 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggat

SEQ ID NO: 31177 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggat

SEQ ID NO: 31178 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggat

SEQ ID NO: 31179 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggat

SEQ ID NO: 31180 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggat

SEQ ID NO: 31181 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggat

SEQ ID NO: 31182 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggat

SEQ ID NO: 31183 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggat

SEQ ID NO: 31184 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggat

SEQ ID NO: 31185 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggat

SEQ ID NO: 31186 - DNA, 187 bp, synthetic construct
  source 1..187: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggat

SEQ ID NO: 31187 - DNA, 138 bp, synthetic construct; identical to SEQ ID NO: 29193
  source 1..138: mol_type = other DNA

SEQ ID NO: 31188 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaaggatt

SEQ ID NO: 31189 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaaggatt

SEQ ID NO: 31190 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaaggatt

SEQ ID NO: 31191 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaaggatt

SEQ ID NO: 31192 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaaggatt

SEQ ID NO: 31193 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaaggatt

SEQ ID NO: 31194 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaaggatt

SEQ ID NO: 31195 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaaggatt

SEQ ID NO: 31196 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaaggatt

SEQ ID NO: 31197 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaaggatt

SEQ ID NO: 31198 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaaggatt

SEQ ID NO: 31199 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaaggatt

SEQ ID NO: 31200 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaaggatt

SEQ ID NO: 31201 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaaggatt

SEQ ID NO: 31202 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaaggatt

SEQ ID NO: 31203 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaaggatt

SEQ ID NO: 31204 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaaggatt

SEQ ID NO: 31205 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaaggatt

SEQ ID NO: 31206 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaaggatt

SEQ ID NO: 31207 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaaggatt

SEQ ID NO: 31208 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaaggatt

SEQ ID NO: 31209 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaaggatt

SEQ ID NO: 31210 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaaggatt

SEQ ID NO: 31211 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaaggatt

SEQ ID NO: 31212 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaaggatt

SEQ ID NO: 31213 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaaggatt

SEQ ID NO: 31214 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaaggatt

SEQ ID NO: 31215 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggatt

SEQ ID NO: 31216 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggatt

SEQ ID NO: 31217 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggatt

SEQ ID NO: 31218 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggatt

SEQ ID NO: 31219 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggatt

SEQ ID NO: 31220 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggatt

SEQ ID NO: 31221 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggatt

SEQ ID NO: 31222 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggatt

SEQ ID NO: 31223 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggatt

SEQ ID NO: 31224 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggatt

SEQ ID NO: 31225 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggatt

SEQ ID NO: 31226 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggatt

SEQ ID NO: 31227 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggatt

SEQ ID NO: 31228 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggatt

SEQ ID NO: 31229 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggatt

SEQ ID NO: 31230 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggatt

SEQ ID NO: 31231 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggatt

SEQ ID NO: 31232 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggatt

SEQ ID NO: 31233 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggatt

SEQ ID NO: 31234 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggatt

SEQ ID NO: 31235 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggatt

SEQ ID NO: 31236 - DNA, 187 bp, synthetic construct
  source 1..187: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggatt

SEQ ID NO: 31237 - DNA, 188 bp, synthetic construct
  source 1..188: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggatt

SEQ ID NO: 31238 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaaggattg

SEQ ID NO: 31239 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaaggattg

SEQ ID NO: 31240 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaaggattg

SEQ ID NO: 31241 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaaggattg

SEQ ID NO: 31242 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaaggattg

SEQ ID NO: 31243 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaaggattg

SEQ ID NO: 31244 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaaggattg

SEQ ID NO: 31245 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaaggattg

SEQ ID NO: 31246 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaaggattg

SEQ ID NO: 31247 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaaggattg

SEQ ID NO: 31248 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaaggattg

SEQ ID NO: 31249 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaaggattg

SEQ ID NO: 31250 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaaggattg

SEQ ID NO: 31251 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaaggattg

SEQ ID NO: 31252 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaaggattg

SEQ ID NO: 31253 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaaggattg

SEQ ID NO: 31254 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaaggattg

SEQ ID NO: 31255 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaaggattg

SEQ ID NO: 31256 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaaggattg

SEQ ID NO: 31257 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaaggattg

SEQ ID NO: 31258 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaaggattg

SEQ ID NO: 31259 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaaggattg

SEQ ID NO: 31260 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaaggattg

SEQ ID NO: 31261 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaaggattg

SEQ ID NO: 31262 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaaggattg

SEQ ID NO: 31263 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaaggattg

SEQ ID NO: 31264 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattg

SEQ ID NO: 31265 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattg

SEQ ID NO: 31266 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattg

SEQ ID NO: 31267 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattg

SEQ ID NO: 31268 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattg

SEQ ID NO: 31269 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattg

SEQ ID NO: 31270 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattg

SEQ ID NO: 31271 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattg

SEQ ID NO: 31272 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattg

SEQ ID NO: 31273 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattg

SEQ ID NO: 31274 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattg

SEQ ID NO: 31275 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattg

SEQ ID NO: 31276 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattg

SEQ ID NO: 31277 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattg

SEQ ID NO: 31278 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattg

SEQ ID NO: 31279 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattg

SEQ ID NO: 31280 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattg

SEQ ID NO: 31281 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattg

SEQ ID NO: 31282 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattg

SEQ ID NO: 31283 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattg

SEQ ID NO: 31284 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattg

SEQ ID NO: 31285 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattg

SEQ ID NO: 31286 - DNA, 187 bp, synthetic construct
  source 1..187: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattg

SEQ ID NO: 31287 - DNA, 188 bp, synthetic construct
  source 1..188: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattg

SEQ ID NO: 31288 - DNA, 189 bp, synthetic construct
  source 1..189: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattg

SEQ ID NO: 31289 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaaggattga

SEQ ID NO: 31290 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaaggattga

SEQ ID NO: 31291 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaaggattga

SEQ ID NO: 31292 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaaggattga

SEQ ID NO: 31293 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaaggattga

SEQ ID NO: 31294 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaaggattga

SEQ ID NO: 31295 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaaggattga

SEQ ID NO: 31296 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaaggattga

SEQ ID NO: 31297 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaaggattga

SEQ ID NO: 31298 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaaggattga

SEQ ID NO: 31299 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaaggattga

SEQ ID NO: 31300 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaaggattga

SEQ ID NO: 31301 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaaggattga

SEQ ID NO: 31302 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaaggattga

SEQ ID NO: 31303 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaaggattga

SEQ ID NO: 31304 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaaggattga

SEQ ID NO: 31305 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaaggattga

SEQ ID NO: 31306 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaaggattga

SEQ ID NO: 31307 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaaggattga

SEQ ID NO: 31308 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaaggattga

SEQ ID NO: 31309 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaaggattga

SEQ ID NO: 31310 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaaggattga

SEQ ID NO: 31311 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaaggattga

SEQ ID NO: 31312 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaaggattga

SEQ ID NO: 31313 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaaggattga

SEQ ID NO: 31314 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaaggattga

SEQ ID NO: 31315 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattga

SEQ ID NO: 31316 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattga

SEQ ID NO: 31317 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattga

SEQ ID NO: 31318 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattga

SEQ ID NO: 31319 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattga

SEQ ID NO: 31320 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattga

SEQ ID NO: 31321 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattga

SEQ ID NO: 31322 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattga

SEQ ID NO: 31323 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattga

SEQ ID NO: 31324 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattga

SEQ ID NO: 31325 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattga

SEQ ID NO: 31326 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattga

SEQ ID NO: 31327 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattga

SEQ ID NO: 31328 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattga

SEQ ID NO: 31329 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattga

SEQ ID NO: 31330 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattga

SEQ ID NO: 31331 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattga

SEQ ID NO: 31332 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattga

SEQ ID NO: 31333 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattga

SEQ ID NO: 31334 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattga

SEQ ID NO: 31335 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattga

SEQ ID NO: 31336 - DNA, 187 bp, synthetic construct
  source 1..187: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattga

SEQ ID NO: 31337 - DNA, 188 bp, synthetic construct
  source 1..188: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattga

SEQ ID NO: 31338 - DNA, 189 bp, synthetic construct
  source 1..189: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattga

SEQ ID NO: 31339 - DNA, 190 bp, synthetic construct
  source 1..190: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattga

SEQ ID NO: 31340 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaaggattgag

SEQ ID NO: 31341 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaaggattgag

SEQ ID NO: 31342 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaaggattgag

SEQ ID NO: 31343 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaaggattgag

SEQ ID NO: 31344 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaaggattgag

SEQ ID NO: 31345 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaaggattgag

SEQ ID NO: 31346 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaaggattgag

SEQ ID NO: 31347 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaaggattgag

SEQ ID NO: 31348 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaaggattgag

SEQ ID NO: 31349 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaaggattgag

SEQ ID NO: 31350 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaaggattgag

SEQ ID NO: 31351 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaaggattgag

SEQ ID NO: 31352 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaaggattgag

SEQ ID NO: 31353 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaaggattgag

SEQ ID NO: 31354 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaaggattgag

SEQ ID NO: 31355 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaaggattgag

SEQ ID NO: 31356 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaaggattgag

SEQ ID NO: 31357 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaaggattgag

SEQ ID NO: 31358 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaaggattgag

SEQ ID NO: 31359 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaaggattgag

SEQ ID NO: 31360 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaaggattgag

SEQ ID NO: 31361 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaaggattgag

SEQ ID NO: 31362 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaaggattgag

SEQ ID NO: 31363 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaaggattgag

SEQ ID NO: 31364 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaaggattgag

SEQ ID NO: 31365 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaaggattgag

SEQ ID NO: 31366 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattgag

SEQ ID NO: 31367 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattgag

SEQ ID NO: 31368 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattgag

SEQ ID NO: 31369 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattgag

SEQ ID NO: 31370 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattgag

SEQ ID NO: 31371 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattgag

SEQ ID NO: 31372 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattgag

SEQ ID NO: 31373 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattgag

SEQ ID NO: 31374 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattgag

SEQ ID NO: 31375 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattgag

SEQ ID NO: 31376 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattgag

SEQ ID NO: 31377 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattgag

SEQ ID NO: 31378 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattgag

SEQ ID NO: 31379 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattgag

SEQ ID NO: 31380 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattgag

SEQ ID NO: 31381 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattgag

SEQ ID NO: 31382 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattgag

SEQ ID NO: 31383 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattgag

SEQ ID NO: 31384 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattgag

SEQ ID NO: 31385 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattgag

SEQ ID NO: 31386 - DNA, 187 bp, synthetic construct
  source 1..187: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattgag

SEQ ID NO: 31387 - DNA, 188 bp, synthetic construct
  source 1..188: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattgag

SEQ ID NO: 31388 - DNA, 189 bp, synthetic construct
  source 1..189: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattgag

SEQ ID NO: 31389 - DNA, 190 bp, synthetic construct
  source 1..190: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattgag

SEQ ID NO: 31390 - DNA, 191 bp, synthetic construct
  source 1..191: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattgag

SEQ ID NO: 31391 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaaggattgagg

SEQ ID NO: 31392 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaaggattgagg

SEQ ID NO: 31393 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaaggattgagg

SEQ ID NO: 31394 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaaggattgagg

SEQ ID NO: 31395 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaaggattgagg

SEQ ID NO: 31396 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaaggattgagg

SEQ ID NO: 31397 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaaggattgagg

SEQ ID NO: 31398 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaaggattgagg

SEQ ID NO: 31399 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaaggattgagg

SEQ ID NO: 31400 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaaggattgagg

SEQ ID NO: 31401 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaaggattgagg

SEQ ID NO: 31402 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaaggattgagg

SEQ ID NO: 31403 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaaggattgagg

SEQ ID NO: 31404 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaaggattgagg

SEQ ID NO: 31405 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaaggattgagg

SEQ ID NO: 31406 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaaggattgagg

SEQ ID NO: 31407 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaaggattgagg

SEQ ID NO: 31408 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaaggattgagg

SEQ ID NO: 31409 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaaggattgagg

SEQ ID NO: 31410 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaaggattgagg

SEQ ID NO: 31411 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaaggattgagg

SEQ ID NO: 31412 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaaggattgagg

SEQ ID NO: 31413 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaaggattgagg

SEQ ID NO: 31414 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaaggattgagg

SEQ ID NO: 31415 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaaggattgagg

SEQ ID NO: 31416 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaaggattgagg

SEQ ID NO: 31417 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattgagg

SEQ ID NO: 31418 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattgagg

SEQ ID NO: 31419 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattgagg

SEQ ID NO: 31420 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattgagg

SEQ ID NO: 31421 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattgagg

SEQ ID NO: 31422 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattgagg

SEQ ID NO: 31423 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattgagg

SEQ ID NO: 31424 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattgagg

SEQ ID NO: 31425 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattgagg

SEQ ID NO: 31426 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattgagg

SEQ ID NO: 31427 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattgagg

SEQ ID NO: 31428 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattgagg

SEQ ID NO: 31429 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattgagg

SEQ ID NO: 31430 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattgagg

SEQ ID NO: 31431 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattgagg

SEQ ID NO: 31432 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattgagg

SEQ ID NO: 31433 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattgagg

SEQ ID NO: 31434 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattgagg

SEQ ID NO: 31435 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattgagg

SEQ ID NO: 31436 - DNA, 187 bp, synthetic construct
  source 1..187: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattgagg

SEQ ID NO: 31437 - DNA, 188 bp, synthetic construct
  source 1..188: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattgagg

SEQ ID NO: 31438 - DNA, 189 bp, synthetic construct
  source 1..189: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattgagg

SEQ ID NO: 31439 - DNA, 190 bp, synthetic construct
  source 1..190: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattgagg

SEQ ID NO: 31440 - DNA, 191 bp, synthetic construct
  source 1..191: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattgagg

SEQ ID NO: 31441 - DNA, 192 bp, synthetic construct
  source 1..192: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattgagg

SEQ ID NO: 31442 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaaggattgaggt

SEQ ID NO: 31443 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaaggattgaggt

SEQ ID NO: 31444 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaaggattgaggt

SEQ ID NO: 31445 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaaggattgaggt

SEQ ID NO: 31446 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaaggattgaggt

SEQ ID NO: 31447 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaaggattgaggt

SEQ ID NO: 31448 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaaggattgaggt

SEQ ID NO: 31449 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaaggattgaggt

SEQ ID NO: 31450 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaaggattgaggt

SEQ ID NO: 31451 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaaggattgaggt

SEQ ID NO: 31452 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaaggattgaggt

SEQ ID NO: 31453 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaaggattgaggt

SEQ ID NO: 31454 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaaggattgaggt

SEQ ID NO: 31455 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaaggattgaggt

SEQ ID NO: 31456 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaaggattgaggt

SEQ ID NO: 31457 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaaggattgaggt

SEQ ID NO: 31458 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaaggattgaggt

SEQ ID NO: 31459 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaaggattgaggt

SEQ ID NO: 31460 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaaggattgaggt

SEQ ID NO: 31461 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaaggattgaggt

SEQ ID NO: 31462 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaaggattgaggt

SEQ ID NO: 31463 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaaggattgaggt

SEQ ID NO: 31464 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaaggattgaggt

SEQ ID NO: 31465 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaaggattgaggt

SEQ ID NO: 31466 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaaggattgaggt

SEQ ID NO: 31467 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaaggattgaggt

SEQ ID NO: 31468 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattgaggt

SEQ ID NO: 31469 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattgaggt

SEQ ID NO: 31470 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattgaggt

SEQ ID NO: 31471 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattgaggt

SEQ ID NO: 31472 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattgaggt

SEQ ID NO: 31473 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattgaggt

SEQ ID NO: 31474 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattgaggt

SEQ ID NO: 31475 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattgaggt

SEQ ID NO: 31476 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattgaggt

SEQ ID NO: 31477 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattgaggt

SEQ ID NO: 31478 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattgaggt

SEQ ID NO: 31479 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattgaggt

SEQ ID NO: 31480 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattgaggt

SEQ ID NO: 31481 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattgaggt

SEQ ID NO: 31482 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattgaggt

SEQ ID NO: 31483 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattgaggt

SEQ ID NO: 31484 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattgaggt

SEQ ID NO: 31485 - DNA, 186 bp, synthetic construct
  source 1..186: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattgaggt

SEQ ID NO: 31486 - DNA, 187 bp, synthetic construct
  source 1..187: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattgaggt

SEQ ID NO: 31487 - DNA, 188 bp, synthetic construct
  source 1..188: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattgaggt

SEQ ID NO: 31488 - DNA, 189 bp, synthetic construct
  source 1..189: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattgaggt

SEQ ID NO: 31489 - DNA, 190 bp, synthetic construct
  source 1..190: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattgaggt

SEQ ID NO: 31490 - DNA, 191 bp, synthetic construct
  source 1..191: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattgaggt

SEQ ID NO: 31491 - DNA, 192 bp, synthetic construct
  source 1..192: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattgaggt

SEQ ID NO: 31492 - DNA, 193 bp, synthetic construct
  source 1..193: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattgaggt

SEQ ID NO: 31493 - DNA, 127 bp, synthetic construct
  source 1..127: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccataca

SEQ ID NO: 31494 - DNA, 128 bp, synthetic construct
  source 1..128: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccataca

SEQ ID NO: 31495 - DNA, 129 bp, synthetic construct
  source 1..129: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccataca

SEQ ID NO: 31496 - DNA, 130 bp, synthetic construct
  source 1..130: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccataca

SEQ ID NO: 31497 - DNA, 131 bp, synthetic construct
  source 1..131: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccataca

SEQ ID NO: 31498 - DNA, 132 bp, synthetic construct
  source 1..132: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccataca

SEQ ID NO: 31499 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccataca

SEQ ID NO: 31500 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccataca

SEQ ID NO: 31501 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccataca

SEQ ID NO: 31502 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccataca

SEQ ID NO: 31503 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccataca

SEQ ID NO: 31504 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccataca

SEQ ID NO: 31505 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccataca

SEQ ID NO: 31506 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccataca

SEQ ID NO: 31507 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccataca

SEQ ID NO: 31508 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccataca

SEQ ID NO: 31509 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccataca

SEQ ID NO: 31510 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccataca

SEQ ID NO: 31511 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccataca

SEQ ID NO: 31512 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccataca

SEQ ID NO: 31513 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccataca

SEQ ID NO: 31514 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccataca

SEQ ID NO: 31515 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccataca

SEQ ID NO: 31516 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccataca

SEQ ID NO: 31517 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccataca

SEQ ID NO: 31518 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccataca

SEQ ID NO: 31519 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccataca

SEQ ID NO: 31520 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccataca

SEQ ID NO: 31521 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccataca

SEQ ID NO: 31522 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccataca

SEQ ID NO: 31523 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccataca

SEQ ID NO: 31524 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccataca

SEQ ID NO: 31525 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccataca

SEQ ID NO: 31526 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccataca

SEQ ID NO: 31527 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccataca

SEQ ID NO: 31528 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccataca

SEQ ID NO: 31529 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccataca

SEQ ID NO: 31530 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccataca

SEQ ID NO: 31531 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccataca

SEQ ID NO: 31532 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccataca

SEQ ID NO: 31533 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccataca

SEQ ID NO: 31534 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccataca

SEQ ID NO: 31535 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccataca

SEQ ID NO: 31536 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccataca

SEQ ID NO: 31537 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccataca

SEQ ID NO: 31538 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccataca

SEQ ID NO: 31539 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccataca

SEQ ID NO: 31540 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccataca

SEQ ID NO: 31541 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccataca

SEQ ID NO: 31542 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccataca

SEQ ID NO: 31543 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccataca

SEQ ID NO: 31544 - DNA, 128 bp, synthetic construct
  source 1..128: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacac

SEQ ID NO: 31545 - DNA, 129 bp, synthetic construct
  source 1..129: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacac

SEQ ID NO: 31546 - DNA, 130 bp, synthetic construct
  source 1..130: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacac

SEQ ID NO: 31547 - DNA, 131 bp, synthetic construct
  source 1..131: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacac

SEQ ID NO: 31548 - DNA, 132 bp, synthetic construct
  source 1..132: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacac

SEQ ID NO: 31549 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacac

SEQ ID NO: 31550 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacac

SEQ ID NO: 31551 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacac

SEQ ID NO: 31552 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacac

SEQ ID NO: 31553 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacac

SEQ ID NO: 31554 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacac

SEQ ID NO: 31555 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacac

SEQ ID NO: 31556 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacac

SEQ ID NO: 31557 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacac

SEQ ID NO: 31558 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacac

SEQ ID NO: 31559 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacac

SEQ ID NO: 31560 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacac

SEQ ID NO: 31561 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacac

SEQ ID NO: 31562 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacac

SEQ ID NO: 31563 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacac

SEQ ID NO: 31564 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacac

SEQ ID NO: 31565 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacac

SEQ ID NO: 31566 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacac

SEQ ID NO: 31567 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacac

SEQ ID NO: 31568 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacac

SEQ ID NO: 31569 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacac

SEQ ID NO: 31570 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacac

SEQ ID NO: 31571 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacac

SEQ ID NO: 31572 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacac

SEQ ID NO: 31573 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacac

SEQ ID NO: 31574 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacac

SEQ ID NO: 31575 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacac

SEQ ID NO: 31576 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacac

SEQ ID NO: 31577 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacac

SEQ ID NO: 31578 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacac

SEQ ID NO: 31579 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacac

SEQ ID NO: 31580 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacac

SEQ ID NO: 31581 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacac

SEQ ID NO: 31582 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacac

SEQ ID NO: 31583 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacac

SEQ ID NO: 31584 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacac

SEQ ID NO: 31585 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacac

SEQ ID NO: 31586 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacac

SEQ ID NO: 31587 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacac

SEQ ID NO: 31588 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacac

SEQ ID NO: 31589 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacac

SEQ ID NO: 31590 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacac

SEQ ID NO: 31591 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacac

SEQ ID NO: 31592 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacac

SEQ ID NO: 31593 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacac

SEQ ID NO: 31594 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacac

SEQ ID NO: 31595 - DNA, 129 bp, synthetic construct
  source 1..129: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacc

SEQ ID NO: 31596 - DNA, 130 bp, synthetic construct
  source 1..130: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacc

SEQ ID NO: 31597 - DNA, 131 bp, synthetic construct
  source 1..131: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacc

SEQ ID NO: 31598 - DNA, 132 bp, synthetic construct
  source 1..132: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacc

SEQ ID NO: 31599 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacc

SEQ ID NO: 31600 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacc

SEQ ID NO: 31601 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacc

SEQ ID NO: 31602 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacc

SEQ ID NO: 31603 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacc

SEQ ID NO: 31604 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacc

SEQ ID NO: 31605 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacc

SEQ ID NO: 31606 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacc

SEQ ID NO: 31607 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacc

SEQ ID NO: 31608 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacc

SEQ ID NO: 31609 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacc

SEQ ID NO: 31610 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacc

SEQ ID NO: 31611 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacc

SEQ ID NO: 31612 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacc

SEQ ID NO: 31613 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacc

SEQ ID NO: 31614 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacc

SEQ ID NO: 31615 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacc

SEQ ID NO: 31616 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacc

SEQ ID NO: 31617 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacc

SEQ ID NO: 31618 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacc

SEQ ID NO: 31619 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacc

SEQ ID NO: 31620 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacc

SEQ ID NO: 31621 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacc

SEQ ID NO: 31622 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacc

SEQ ID NO: 31623 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacc

SEQ ID NO: 31624 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacc

SEQ ID NO: 31625 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacc

SEQ ID NO: 31626 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacc

SEQ ID NO: 31627 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacc

SEQ ID NO: 31628 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacc

SEQ ID NO: 31629 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacc

SEQ ID NO: 31630 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacc

SEQ ID NO: 31631 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacc

SEQ ID NO: 31632 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacc

SEQ ID NO: 31633 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacc

SEQ ID NO: 31634 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacc

SEQ ID NO: 31635 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacc

SEQ ID NO: 31636 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacc

SEQ ID NO: 31637 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacc

SEQ ID NO: 31638 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacc

SEQ ID NO: 31639 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacc

SEQ ID NO: 31640 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacc

SEQ ID NO: 31641 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacc

SEQ ID NO: 31642 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacc

SEQ ID NO: 31643 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacc

SEQ ID NO: 31644 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacc

SEQ ID NO: 31645 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacc

SEQ ID NO: 31646 - DNA, 130 bp, synthetic construct
  source 1..130: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacaccc

SEQ ID NO: 31647 - DNA, 131 bp, synthetic construct
  source 1..131: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacaccc

SEQ ID NO: 31648 - DNA, 132 bp, synthetic construct
  source 1..132: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacaccc

SEQ ID NO: 31649 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacaccc

SEQ ID NO: 31650 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacaccc

SEQ ID NO: 31651 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacaccc

SEQ ID NO: 31652 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacaccc

SEQ ID NO: 31653 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacaccc

SEQ ID NO: 31654 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacaccc

SEQ ID NO: 31655 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacaccc

SEQ ID NO: 31656 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacaccc

SEQ ID NO: 31657 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacaccc

SEQ ID NO: 31658 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacaccc

SEQ ID NO: 31659 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacaccc

SEQ ID NO: 31660 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacaccc

SEQ ID NO: 31661 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacaccc

SEQ ID NO: 31662 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacaccc

SEQ ID NO: 31663 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacaccc

SEQ ID NO: 31664 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacaccc

SEQ ID NO: 31665 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacaccc

SEQ ID NO: 31666 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacaccc

SEQ ID NO: 31667 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacaccc

SEQ ID NO: 31668 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacaccc

SEQ ID NO: 31669 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacaccc

SEQ ID NO: 31670 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacaccc

SEQ ID NO: 31671 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacaccc

SEQ ID NO: 31672 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacaccc

SEQ ID NO: 31673 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacaccc

SEQ ID NO: 31674 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacaccc

SEQ ID NO: 31675 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacaccc

SEQ ID NO: 31676 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacaccc

SEQ ID NO: 31677 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacaccc

SEQ ID NO: 31678 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacaccc

SEQ ID NO: 31679 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacaccc

SEQ ID NO: 31680 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacaccc

SEQ ID NO: 31681 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacaccc

SEQ ID NO: 31682 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacaccc

SEQ ID NO: 31683 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacaccc

SEQ ID NO: 31684 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacaccc

SEQ ID NO: 31685 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacaccc

SEQ ID NO: 31686 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacaccc

SEQ ID NO: 31687 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacaccc

SEQ ID NO: 31688 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacaccc

SEQ ID NO: 31689 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacaccc

SEQ ID NO: 31690 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacaccc

SEQ ID NO: 31691 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacaccc

SEQ ID NO: 31692 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacaccc

SEQ ID NO: 31693 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacaccc

SEQ ID NO: 31694 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacaccc

SEQ ID NO: 31695 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacaccc

SEQ ID NO: 31696 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacaccc

SEQ ID NO: 31697 - DNA, 131 bp, synthetic construct
  source 1..131: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacaccca

SEQ ID NO: 31698 - DNA, 132 bp, synthetic construct
  source 1..132: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacaccca

SEQ ID NO: 31699 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacaccca

SEQ ID NO: 31700 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacaccca

SEQ ID NO: 31701 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacaccca

SEQ ID NO: 31702 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacaccca

SEQ ID NO: 31703 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacaccca

SEQ ID NO: 31704 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacaccca

SEQ ID NO: 31705 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacaccca

SEQ ID NO: 31706 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacaccca

SEQ ID NO: 31707 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacaccca

SEQ ID NO: 31708 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacaccca

SEQ ID NO: 31709 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacaccca

SEQ ID NO: 31710 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacaccca

SEQ ID NO: 31711 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacaccca

SEQ ID NO: 31712 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacaccca

SEQ ID NO: 31713 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacaccca

SEQ ID NO: 31714 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacaccca

SEQ ID NO: 31715 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacaccca

SEQ ID NO: 31716 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacaccca

SEQ ID NO: 31717 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacaccca

SEQ ID NO: 31718 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacaccca

SEQ ID NO: 31719 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacaccca

SEQ ID NO: 31720 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacaccca

SEQ ID NO: 31721 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacaccca

SEQ ID NO: 31722 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacaccca

SEQ ID NO: 31723 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacaccca

SEQ ID NO: 31724 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacaccca

SEQ ID NO: 31725 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacaccca

SEQ ID NO: 31726 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacaccca

SEQ ID NO: 31727 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacaccca

SEQ ID NO: 31728 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacaccca

SEQ ID NO: 31729 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacaccca

SEQ ID NO: 31730 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacaccca

SEQ ID NO: 31731 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacaccca

SEQ ID NO: 31732 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacaccca

SEQ ID NO: 31733 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacaccca

SEQ ID NO: 31734 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacaccca

SEQ ID NO: 31735 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacaccca

SEQ ID NO: 31736 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacaccca

SEQ ID NO: 31737 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacaccca

SEQ ID NO: 31738 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacaccca

SEQ ID NO: 31739 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacaccca

SEQ ID NO: 31740 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacaccca

SEQ ID NO: 31741 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacaccca

SEQ ID NO: 31742 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacaccca

SEQ ID NO: 31743 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacaccca

SEQ ID NO: 31744 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacaccca

SEQ ID NO: 31745 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacaccca

SEQ ID NO: 31746 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacaccca

SEQ ID NO: 31747 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacaccca

SEQ ID NO: 31748 - DNA, 132 bp, synthetic construct
  source 1..132: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaa

SEQ ID NO: 31749 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaa

SEQ ID NO: 31750 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaa

SEQ ID NO: 31751 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaa

SEQ ID NO: 31752 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaa

SEQ ID NO: 31753 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaa

SEQ ID NO: 31754 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaa

SEQ ID NO: 31755 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaa

SEQ ID NO: 31756 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaa

SEQ ID NO: 31757 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaa

SEQ ID NO: 31758 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaa

SEQ ID NO: 31759 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaa

SEQ ID NO: 31760 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaa

SEQ ID NO: 31761 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaa

SEQ ID NO: 31762 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaa

SEQ ID NO: 31763 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaa

SEQ ID NO: 31764 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaa

SEQ ID NO: 31765 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaa

SEQ ID NO: 31766 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaa

SEQ ID NO: 31767 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaa

SEQ ID NO: 31768 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaa

SEQ ID NO: 31769 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaa

SEQ ID NO: 31770 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaa

SEQ ID NO: 31771 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaa

SEQ ID NO: 31772 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaa

SEQ ID NO: 31773 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaa

SEQ ID NO: 31774 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaa

SEQ ID NO: 31775 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaa

SEQ ID NO: 31776 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaa

SEQ ID NO: 31777 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaa

SEQ ID NO: 31778 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaa

SEQ ID NO: 31779 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaa

SEQ ID NO: 31780 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaa

SEQ ID NO: 31781 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaa

SEQ ID NO: 31782 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaa

SEQ ID NO: 31783 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaa

SEQ ID NO: 31784 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaa

SEQ ID NO: 31785 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaa

SEQ ID NO: 31786 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaa

SEQ ID NO: 31787 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaa

SEQ ID NO: 31788 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaa

SEQ ID NO: 31789 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaa

SEQ ID NO: 31790 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaa

SEQ ID NO: 31791 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaa

SEQ ID NO: 31792 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaa

SEQ ID NO: 31793 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaa

SEQ ID NO: 31794 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaa

SEQ ID NO: 31795 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaa

SEQ ID NO: 31796 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaa

SEQ ID NO: 31797 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaa

SEQ ID NO: 31798 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaa

SEQ ID NO: 31799 - DNA, 133 bp, synthetic construct
  source 1..133: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaa

SEQ ID NO: 31800 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaa

SEQ ID NO: 31801 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaa

SEQ ID NO: 31802 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaa

SEQ ID NO: 31803 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaa

SEQ ID NO: 31804 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaa

SEQ ID NO: 31805 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaa

SEQ ID NO: 31806 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaa

SEQ ID NO: 31807 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaa

SEQ ID NO: 31808 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaa

SEQ ID NO: 31809 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaa

SEQ ID NO: 31810 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaa

SEQ ID NO: 31811 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaa

SEQ ID NO: 31812 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaa

SEQ ID NO: 31813 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaa

SEQ ID NO: 31814 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaa

SEQ ID NO: 31815 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaa

SEQ ID NO: 31816 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaa

SEQ ID NO: 31817 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaa

SEQ ID NO: 31818 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaa

SEQ ID NO: 31819 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaa

SEQ ID NO: 31820 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaa

SEQ ID NO: 31821 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaa

SEQ ID NO: 31822 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaa

SEQ ID NO: 31823 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaa

SEQ ID NO: 31824 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaa

SEQ ID NO: 31825 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaa

SEQ ID NO: 31826 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaa

SEQ ID NO: 31827 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaa

SEQ ID NO: 31828 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaa

SEQ ID NO: 31829 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaa

SEQ ID NO: 31830 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaa

SEQ ID NO: 31831 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaa

SEQ ID NO: 31832 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaa

SEQ ID NO: 31833 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaa

SEQ ID NO: 31834 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaa

SEQ ID NO: 31835 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaa

SEQ ID NO: 31836 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaa

SEQ ID NO: 31837 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaa

SEQ ID NO: 31838 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaa

SEQ ID NO: 31839 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaa

SEQ ID NO: 31840 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaa

SEQ ID NO: 31841 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaa

SEQ ID NO: 31842 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaa

SEQ ID NO: 31843 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaa

SEQ ID NO: 31844 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaa

SEQ ID NO: 31845 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaa

SEQ ID NO: 31846 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaa

SEQ ID NO: 31847 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaa

SEQ ID NO: 31848 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaa

SEQ ID NO: 31849 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaa

SEQ ID NO: 31850 - DNA, 134 bp, synthetic construct
  source 1..134: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaag

SEQ ID NO: 31851 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaag

SEQ ID NO: 31852 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaag

SEQ ID NO: 31853 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaag

SEQ ID NO: 31854 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaag

SEQ ID NO: 31855 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaag

SEQ ID NO: 31856 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaag

SEQ ID NO: 31857 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaag

SEQ ID NO: 31858 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaag

SEQ ID NO: 31859 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaag

SEQ ID NO: 31860 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaag

SEQ ID NO: 31861 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaag

SEQ ID NO: 31862 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaag

SEQ ID NO: 31863 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaag

SEQ ID NO: 31864 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaag

SEQ ID NO: 31865 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaag

SEQ ID NO: 31866 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaag

SEQ ID NO: 31867 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaag

SEQ ID NO: 31868 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaag

SEQ ID NO: 31869 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaag

SEQ ID NO: 31870 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaag

SEQ ID NO: 31871 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaag

SEQ ID NO: 31872 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaag

SEQ ID NO: 31873 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaag

SEQ ID NO: 31874 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaag

SEQ ID NO: 31875 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaag

SEQ ID NO: 31876 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaag

SEQ ID NO: 31877 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaag

SEQ ID NO: 31878 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaag

SEQ ID NO: 31879 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaag

SEQ ID NO: 31880 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaag

SEQ ID NO: 31881 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaag

SEQ ID NO: 31882 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaag

SEQ ID NO: 31883 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaag

SEQ ID NO: 31884 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaag

SEQ ID NO: 31885 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaag

SEQ ID NO: 31886 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaag

SEQ ID NO: 31887 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaag

SEQ ID NO: 31888 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaag

SEQ ID NO: 31889 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaag

SEQ ID NO: 31890 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaag

SEQ ID NO: 31891 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaag

SEQ ID NO: 31892 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaag

SEQ ID NO: 31893 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaag

SEQ ID NO: 31894 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaag

SEQ ID NO: 31895 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaag

SEQ ID NO: 31896 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaag

SEQ ID NO: 31897 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaag

SEQ ID NO: 31898 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaag

SEQ ID NO: 31899 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaag

SEQ ID NO: 31900 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaag

SEQ ID NO: 31901 - DNA, 135 bp, synthetic construct
  source 1..135: mol_type = other DNA
acctcaatcctttgggtgtagttttagagctagaaatagcaagttaaaataaggctagtccgttatcaacttgaaaaagtggcaccgagtcggtgccggcccttctcagttcgctacgacccatacacccaaagg

SEQ ID NO: 31902 - DNA, 136 bp, synthetic construct
  source 1..136: mol_type = other DNA
acctcaatcctttgggtgtagttttagagctagaaatagcaagttaaaataaggctagtccgttatcaacttgaaaaagtggcaccgagtcggtgctcggcccttctcagttcgctacgacccatacacccaaagg

SEQ ID NO: 31903 - DNA, 137 bp, synthetic construct
  source 1..137: mol_type = other DNA
acctcaatcctttgggtgtagttttagagctagaaatagcaagttaaaataaggctagtccgttatcaacttgaaaaagtggcaccgagtcggtgcctcggcccttctcagttcgctacgacccatacacccaaagg

SEQ ID NO: 31904 - DNA, 138 bp, synthetic construct
  source 1..138: mol_type = other DNA
acctcaatcctttgggtgtagttttagagctagaaatagcaagttaaaataaggctagtccgttatcaacttgaaaaagtggcaccgagtcggtgccctcggcccttctcagttcgctacgacccatacacccaaagg

SEQ ID NO: 31905 - DNA, 139 bp, synthetic construct
  source 1..139: mol_type = other DNA
acctcaatcctttgggtgtagttttagagctagaaatagcaagttaaaataaggctagtccgttatcaacttgaaaaagtggcaccgagtcggtgcacctcggcccttctcagttcgctacgacccatacacccaaagg

SEQ ID NO: 31906 - DNA, 140 bp, synthetic construct
  source 1..140: mol_type = other DNA
acctcaatcctttgggtgtagttttagagctagaaatagcaagttaaaataaggctagtccgttatcaacttgaaaaagtggcaccgagtcggtgctacctcggcccttctcagttcgctacgacccatacacccaaagg

SEQ ID NO: 31907 - DNA, 141 bp, synthetic construct
  source 1..141: mol_type = other DNA
acctcaatcctttgggtgtagttttagagctagaaatagcaagttaaaataaggctagtccgttatcaacttgaaaaagtggcaccgagtcggtgcatacctcggcccttctcagttcgctacgacccatacacccaaagg

SEQ ID NO: 31908 - DNA, 142 bp, synthetic construct
  source 1..142: mol_type = other DNA
acctcaatcctttgggtgtagttttagagctagaaatagcaagttaaaataaggctagtccgttatcaacttgaaaaagtggcaccgagtcggtgcaatacctcggcccttctcagttcgctacgacccatacacccaaagg

SEQ ID NO: 31909 - DNA, 143 bp, synthetic construct
  source 1..143: mol_type = other DNA
acctcaatcctttgggtgtagttttagagctagaaatagcaagttaaaataaggctagtccgttatcaacttgaaaaagtggcaccgagtcggtgccaatacctcggcccttctcagttcgctacgacccatacacccaaagg

SEQ ID NO: 31910 - DNA, 144 bp, synthetic construct
  source 1..144: mol_type = other DNA
acctcaatcctttgggtgtagttttagagctagaaatagcaagttaaaataaggctagtccgttatcaacttgaaaaagtggcaccgagtcggtgcacaatacctcggcccttctcagttcgctacgacccatacacccaaagg

SEQ ID NO: 31911 - DNA, 145 bp, synthetic construct
  source 1..145: mol_type = other DNA
acctcaatcctttgggtgtagttttagagctagaaatagcaagttaaaataaggctagtccgttatcaacttgaaaaagtggcaccgagtcggtgccacaatacctcggcccttctcagttcgctacgacccatacacccaaagg

SEQ ID NO: 31912 - DNA, 146 bp, synthetic construct
  source 1..146: mol_type = other DNA
acctcaatcctttgggtgtagttttagagctagaaatagcaagttaaaataaggctagtccgttatcaacttgaaaaagtggcaccgagtcggtgcccacaatacctcggcccttctcagttcgctacgacccatacacccaaagg

SEQ ID NO: 31913 - DNA, 147 bp, synthetic construct
  source 1..147: mol_type = other DNA
acctcaatcctttgggtgtagttttagagctagaaatagcaagttaaaataaggctagtccgttatcaacttgaaaaagtggcaccgagtcggtgcgccacaatacctcggcccttctcagttcgctacgacccatacacccaaagg

SEQ ID NO: 31914 - DNA, 148 bp, synthetic construct
  source 1..148: mol_type = other DNA
acctcaatcctttgggtgtagttttagagctagaaatagcaagttaaaataaggctagtccgttatcaacttgaaaaagtggcaccgagtcggtgctgccacaatacctcggcccttctcagttcgctacgacccatacacccaaagg

SEQ ID NO: 31915 - DNA, 149 bp, synthetic construct
  source 1..149: mol_type = other DNA
acctcaatcctttgggtgtagttttagagctagaaatagcaagttaaaataaggctagtccgttatcaacttgaaaaagtggcaccgagtcggtgcctgccacaatacctcggcccttctcagttcgctacgacccatacacccaaagg

SEQ ID NO: 31916 - DNA, 150 bp, synthetic construct
  source 1..150: mol_type = other DNA
acctcaatcctttgggtgtagttttagagctagaaatagcaagttaaaataaggctagtccgttatcaacttgaaaaagtggcaccgagtcggtgcgctgccacaatacctcggcccttctcagttcgctacgacccatacacccaaagg

SEQ ID NO: 31917 - DNA, 151 bp, synthetic construct
  source 1..151: mol_type = other DNA
acctcaatcctttgggtgtagttttagagctagaaatagcaagttaaaataaggctagtccgttatcaacttgaaaaagtggcaccgagtcggtgctgctgccacaatacctcggcccttctcagttcgctacgacccatacacccaaagg

SEQ ID NO: 31918 - DNA, 152 bp, synthetic construct
  source 1..152: mol_type = other DNA
acctcaatcctttgggtgtagttttagagctagaaatagcaagttaaaataaggctagtccgttatcaacttgaaaaagtggcaccgagtcggtgcttgctgccacaatacctcggcccttctcagttcgctacgacccatacacccaaagg

SEQ ID NO: 31919 - DNA, 153 bp, synthetic construct
  source 1..153: mol_type = other DNA
acctcaatcctttgggtgtagttttagagctagaaatagcaagttaaaataaggctagtccgttatcaacttgaaaaagtggcaccgagtcggtgctttgctgccacaatacctcggcccttctcagttcgctacgacccatacacccaaagg

SEQ ID NO: 31920 - DNA, 154 bp, synthetic construct
  source 1..154: mol_type = other DNA
acctcaatcctttgggtgtagttttagagctagaaatagcaagttaaaataaggctagtccgttatcaacttgaaaaagtggcaccgagtcggtgcctttgctgccacaatacctcggcccttctcagttcgctacgacccatacacccaaagg

SEQ ID NO: 31921 - DNA, 155 bp, synthetic construct
  source 1..155: mol_type = other DNA
acctcaatcctttgggtgtagttttagagctagaaatagcaagttaaaataaggctagtccgttatcaacttgaaaaagtggcaccgagtcggtgcactttgctgccacaatacctcggcccttctcagttcgctacgacccatacacccaaagg

SEQ ID NO: 31922 - DNA, 156 bp, synthetic construct
  source 1..156: mol_type = other DNA
acctcaatcctttgggtgtagttttagagctagaaatagcaagttaaaataaggctagtccgttatcaacttgaaaaagtggcaccgagtcggtgcaactttgctgccacaatacctcggcccttctcagttcgctacgacccatacacccaaagg

SEQ ID NO: 31923 - DNA, 157 bp, synthetic construct
  source 1..157: mol_type = other DNA
acctcaatcctttgggtgtagttttagagctagaaatagcaagttaaaataaggctagtccgttatcaacttgaaaaagtggcaccgagtcggtgcgaactttgctgccacaatacctcggcccttctcagttcgctacgacccatacacccaaagg

SEQ ID NO: 31924 - DNA, 158 bp, synthetic construct
  source 1..158: mol_type = other DNA
acctcaatcctttgggtgtagttttagagctagaaatagcaagttaaaataaggctagtccgttatcaacttgaaaaagtggcaccgagtcggtgcggaactttgctgccacaatacctcggcccttctcagttcgctacgacccatacacccaaagg

SEQ ID NO: 31925 - DNA, 159 bp, synthetic construct
  source 1..159: mol_type = other DNA
acctcaatcctttgggtgtagttttagagctagaaatagcaagttaaaataaggctagtccgttatcaacttgaaaaagtggcaccgagtcggtgcaggaactttgctgccacaatacctcggcccttctcagttcgctacgacccatacacccaaagg

SEQ ID NO: 31926 - DNA, 160 bp, synthetic construct
  source 1..160: mol_type = other DNA
acctcaatcctttgggtgtagttttagagctagaaatagcaagttaaaataaggctagtccgttatcaacttgaaaaagtggcaccgagtcggtgctaggaactttgctgccacaatacctcggcccttctcagttcgctacgacccatacacccaaagg

SEQ ID NO: 31927 - DNA, 161 bp, synthetic construct
  source 1..161: mol_type = other DNA
acctcaatcctttgggtgtagttttagagctagaaatagcaagttaaaataaggctagtccgttatcaacttgaaaaagtggcaccgagtcggtgcttaggaactttgctgccacaatacctcggcccttctcagttcgctacgacccatacacccaaagg

SEQ ID NO: 31928 - DNA, 162 bp, synthetic construct
  source 1..162: mol_type = other DNA
acctcaatcctttgggtgtagttttagagctagaaatagcaagttaaaataaggctagtccgttatcaacttgaaaaagtggcaccgagtcggtgccttaggaactttgctgccacaatacctcggcccttctcagttcgctacgacccatacacccaaagg

SEQ ID NO: 31929 - DNA, 163 bp, synthetic construct
  source 1..163: mol_type = other DNA
acctcaatcctttgggtgtagttttagagctagaaatagcaagttaaaataaggctagtccgttatcaacttgaaaaagtggcaccgagtcggtgctcttaggaactttgctgccacaatacctcggcccttctcagttcgctacgacccatacacccaaagg

SEQ ID NO: 31930 - DNA, 164 bp, synthetic construct
  source 1..164: mol_type = other DNA
acctcaatcctttgggtgtagttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaagg

SEQ ID NO: 31931 - DNA, 165 bp, synthetic construct
  source 1..165: mol_type = other DNA
acctcaatcctttgggtgtagttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaagg

SEQ ID NO: 31932 - DNA, 166 bp, synthetic construct
  source 1..166: mol_type = other DNA
acctcaatcctttgggtgtagttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaagg

SEQ ID NO: 31933 - DNA, 167 bp, synthetic construct
  source 1..167: mol_type = other DNA
acctcaatcctttgggtgtagttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaagg

SEQ ID NO: 31934 - DNA, 168 bp, synthetic construct
  source 1..168: mol_type = other DNA
acctcaatcctttgggtgtagttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaagg

SEQ ID NO: 31935 - DNA, 169 bp, synthetic construct
  source 1..169: mol_type = other DNA
acctcaatcctttgggtgtagttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaagg

SEQ ID NO: 31936 - DNA, 170 bp, synthetic construct
  source 1..170: mol_type = other DNA
acctcaatcctttgggtgtagttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaagg

SEQ ID NO: 31937 - DNA, 171 bp, synthetic construct
  source 1..171: mol_type = other DNA
acctcaatcctttgggtgtagttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaagg

SEQ ID NO: 31938 - DNA, 172 bp, synthetic construct
  source 1..172: mol_type = other DNA
acctcaatcctttgggtgtagttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaagg

SEQ ID NO: 31939 - DNA, 173 bp, synthetic construct
  source 1..173: mol_type = other DNA
acctcaatcctttgggtgtagttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaagg

SEQ ID NO: 31940 - DNA, 174 bp, synthetic construct
  source 1..174: mol_type = other DNA
acctcaatcctttgggtgtagttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaagg

SEQ ID NO: 31941 - DNA, 175 bp, synthetic construct
  source 1..175: mol_type = other DNA
acctcaatcctttgggtgtagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaagg

SEQ ID NO: 31942 - DNA, 176 bp, synthetic construct
  source 1..176: mol_type = other DNA
acctcaatcctttgggtgtagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaagg

SEQ ID NO: 31943 - DNA, 177 bp, synthetic construct
  source 1..177: mol_type = other DNA
acctcaatcctttgggtgtagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaagg

SEQ ID NO: 31944 - DNA, 178 bp, synthetic construct
  source 1..178: mol_type = other DNA
acctcaatcctttgggtgtagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaagg

SEQ ID NO: 31945 - DNA, 179 bp, synthetic construct
  source 1..179: mol_type = other DNA
acctcaatcctttgggtgtagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaagg

SEQ ID NO: 31946 - DNA, 180 bp, synthetic construct
  source 1..180: mol_type = other DNA
acctcaatcctttgggtgtagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaagg

SEQ ID NO: 31947 - DNA, 181 bp, synthetic construct
  source 1..181: mol_type = other DNA
acctcaatcctttgggtgtagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaagg

SEQ ID NO: 31948 - DNA, 182 bp, synthetic construct
  source 1..182: mol_type = other DNA
acctcaatcctttgggtgtagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaagg

SEQ ID NO: 31949 - DNA, 183 bp, synthetic construct
  source 1..183: mol_type = other DNA
acctcaatcctttgggtgtagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaagg

SEQ ID NO: 31950 - DNA, 184 bp, synthetic construct
  source 1..184: mol_type = other DNA
acctcaatcctttgggtgtagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaagg

SEQ ID NO: 31951 - DNA, 185 bp, synthetic construct
  source 1..185: mol_type = other DNA
acctcaatcctttgggtgtagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaagg

SEQ ID NO: 31952 - DNA, 125 bp, synthetic construct
  source 1..125: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccata

SEQ ID NO: 31953 - DNA, 126 bp, synthetic construct
  source 1..126: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccata

SEQ ID NO: 31954 - DNA, 127 bp, synthetic construct
  source 1..127: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccata

SEQ ID NO: 31955 - DNA, 128 bp, synthetic construct
  source 1..128: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccata

SEQ ID NO: 31956 - DNA, 129 bp, synthetic construct
  source 1..129: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccata

SEQ ID NO: 31957 - DNA, 130 bp, synthetic construct
  source 1..130: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccata

SEQ ID NO: 31958 - DNA, 131 bp, synthetic construct
  source 1..131: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccata

SEQ ID NO: 31959 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccata

SEQ ID NO: 31960 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccata

SEQ ID NO: 31961 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccata

SEQ ID NO: 31962 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccata

SEQ ID NO: 31963 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccata

SEQ ID NO: 31964 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccata

SEQ ID NO: 31965 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccata

SEQ ID NO: 31966 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccata

SEQ ID NO: 31967 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccata

SEQ ID NO: 31968 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccata

SEQ ID NO: 31969 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccata

SEQ ID NO: 31970 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccata

SEQ ID NO: 31971 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccata

SEQ ID NO: 31972 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccata

SEQ ID NO: 31973 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccata

SEQ ID NO: 31974 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccata

SEQ ID NO: 31975 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccata

SEQ ID NO: 31976 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccata

SEQ ID NO: 31977 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccata

SEQ ID NO: 31978 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccata

SEQ ID NO: 31979 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccata

SEQ ID NO: 31980 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccata

SEQ ID NO: 31981 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccata

SEQ ID NO: 31982 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccata

SEQ ID NO: 31983 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccata

SEQ ID NO: 31984 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccata

SEQ ID NO: 31985 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccata

SEQ ID NO: 31986 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccata

SEQ ID NO: 31987 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccata

SEQ ID NO: 31988 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccata

SEQ ID NO: 31989 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccata

SEQ ID NO: 31990 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccata

SEQ ID NO: 31991 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccata

SEQ ID NO: 31992 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccata

SEQ ID NO: 31993 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccata

SEQ ID NO: 31994 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccata

SEQ ID NO: 31995 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccata

SEQ ID NO: 31996 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccata

SEQ ID NO: 31997 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccata

SEQ ID NO: 31998 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccata

SEQ ID NO: 31999 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccata

SEQ ID NO: 32000 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccata

SEQ ID NO: 32001 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccata

SEQ ID NO: 32002 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccata

SEQ ID NO: 32003 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaagg

SEQ ID NO: 32004 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaagg

SEQ ID NO: 32005 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaagg

SEQ ID NO: 32006 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaagg

SEQ ID NO: 32007 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaagg

SEQ ID NO: 32008 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaagg

SEQ ID NO: 32009 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaagg

SEQ ID NO: 32010 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaagg

SEQ ID NO: 32011 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaagg

SEQ ID NO: 32012 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaagg

SEQ ID NO: 32013 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaagg

SEQ ID NO: 32014 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaagg

SEQ ID NO: 32015 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaagg

SEQ ID NO: 32016 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaagg

SEQ ID NO: 32017 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaagg

SEQ ID NO: 32018 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaagg

SEQ ID NO: 32019 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaagg

SEQ ID NO: 32020 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaagg

SEQ ID NO: 32021 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaagg

SEQ ID NO: 32022 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaagg

SEQ ID NO: 32023 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaagg

SEQ ID NO: 32024 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaagg

SEQ ID NO: 32025 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaagg

SEQ ID NO: 32026 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaagg

SEQ ID NO: 32027 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaagg

SEQ ID NO: 32028 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaagg

SEQ ID NO: 32029 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaagg

SEQ ID NO: 32030 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaagg

SEQ ID NO: 32031 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaagg

SEQ ID NO: 32032 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaagg

SEQ ID NO: 32033 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaagg

SEQ ID NO: 32034 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaagg

SEQ ID NO: 32035 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaagg

SEQ ID NO: 32036 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaagg

SEQ ID NO: 32037 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaagg

SEQ ID NO: 32038 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaagg

SEQ ID NO: 32039 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaagg

SEQ ID NO: 32040 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaagg

SEQ ID NO: 32041 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaagg

SEQ ID NO: 32042 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaagg

SEQ ID NO: 32043 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaagg

SEQ ID NO: 32044 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaagg

SEQ ID NO: 32045 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaagg

SEQ ID NO: 32046 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaagg

SEQ ID NO: 32047 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaagg

SEQ ID NO: 32048 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaagg

SEQ ID NO: 32049 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaagg

SEQ ID NO: 32050 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaagg

SEQ ID NO: 32051 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaagg

SEQ ID NO: 32052 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaagg

SEQ ID NO: 32053 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaagg

SEQ ID NO: 32054 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaagga

SEQ ID NO: 32055 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaagga

SEQ ID NO: 32056 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaagga

SEQ ID NO: 32057 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaagga

SEQ ID NO: 32058 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaagga

SEQ ID NO: 32059 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaagga

SEQ ID NO: 32060 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaagga

SEQ ID NO: 32061 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaagga

SEQ ID NO: 32062 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaagga

SEQ ID NO: 32063 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaagga

SEQ ID NO: 32064 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaagga

SEQ ID NO: 32065 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaagga

SEQ ID NO: 32066 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaagga

SEQ ID NO: 32067 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaagga

SEQ ID NO: 32068 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaagga

SEQ ID NO: 32069 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaagga

SEQ ID NO: 32070 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaagga

SEQ ID NO: 32071 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaagga

SEQ ID NO: 32072 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaagga

SEQ ID NO: 32073 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaagga

SEQ ID NO: 32074 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaagga

SEQ ID NO: 32075 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaagga

SEQ ID NO: 32076 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaagga

SEQ ID NO: 32077 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaagga

SEQ ID NO: 32078 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaagga

SEQ ID NO: 32079 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaagga

SEQ ID NO: 32080 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaagga

SEQ ID NO: 32081 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaagga

SEQ ID NO: 32082 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaagga

SEQ ID NO: 32083 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaagga

SEQ ID NO: 32084 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaagga

SEQ ID NO: 32085 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaagga

SEQ ID NO: 32086 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaagga

SEQ ID NO: 32087 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaagga

SEQ ID NO: 32088 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaagga

SEQ ID NO: 32089 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaagga

SEQ ID NO: 32090 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaagga

SEQ ID NO: 32091 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaagga

SEQ ID NO: 32092 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaagga

SEQ ID NO: 32093 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaagga

SEQ ID NO: 32094 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaagga

SEQ ID NO: 32095 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaagga

SEQ ID NO: 32096 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaagga

SEQ ID NO: 32097 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaagga

SEQ ID NO: 32098 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaagga

SEQ ID NO: 32099 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaagga

SEQ ID NO: 32100 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaagga

SEQ ID NO: 32101 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaagga

SEQ ID NO: 32102 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaagga

SEQ ID NO: 32103 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaagga

SEQ ID NO: 32104 - DNA, 186 bp, synthetic construct
  source 1..186: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaagga

SEQ ID NO: 32105 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaaggat

SEQ ID NO: 32106 - DNA, 138 bp, synthetic construct; identical to SEQ ID NO: 29181
  source 1..138: mol_type = other DNA

SEQ ID NO: 32107 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaaggat

SEQ ID NO: 32108 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaaggat

SEQ ID NO: 32109 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaaggat

SEQ ID NO: 32110 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaaggat

SEQ ID NO: 32111 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaaggat

SEQ ID NO: 32112 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaaggat

SEQ ID NO: 32113 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaaggat

SEQ ID NO: 32114 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaaggat

SEQ ID NO: 32115 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaaggat

SEQ ID NO: 32116 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaaggat

SEQ ID NO: 32117 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaaggat

SEQ ID NO: 32118 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaaggat

SEQ ID NO: 32119 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaaggat

SEQ ID NO: 32120 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaaggat

SEQ ID NO: 32121 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaaggat

SEQ ID NO: 32122 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaaggat

SEQ ID NO: 32123 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaaggat

SEQ ID NO: 32124 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaaggat

SEQ ID NO: 32125 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaaggat

SEQ ID NO: 32126 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaaggat

SEQ ID NO: 32127 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaaggat

SEQ ID NO: 32128 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaaggat

SEQ ID NO: 32129 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaaggat

SEQ ID NO: 32130 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaaggat

SEQ ID NO: 32131 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaaggat

SEQ ID NO: 32132 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaaggat

SEQ ID NO: 32133 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggat

SEQ ID NO: 32134 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggat

SEQ ID NO: 32135 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggat

SEQ ID NO: 32136 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggat

SEQ ID NO: 32137 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggat

SEQ ID NO: 32138 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggat

SEQ ID NO: 32139 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggat

SEQ ID NO: 32140 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggat

SEQ ID NO: 32141 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggat

SEQ ID NO: 32142 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggat

SEQ ID NO: 32143 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggat

SEQ ID NO: 32144 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggat

SEQ ID NO: 32145 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggat

SEQ ID NO: 32146 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggat

SEQ ID NO: 32147 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggat

SEQ ID NO: 32148 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggat

SEQ ID NO: 32149 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggat

SEQ ID NO: 32150 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggat

SEQ ID NO: 32151 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggat

SEQ ID NO: 32152 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggat

SEQ ID NO: 32153 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggat

SEQ ID NO: 32154 - DNA, 186 bp, synthetic construct
  source 1..186: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggat

SEQ ID NO: 32155 - DNA, 187 bp, synthetic construct
  source 1..187: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggat

SEQ ID NO: 32156 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaaggatt

SEQ ID NO: 32157 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaaggatt

SEQ ID NO: 32158 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaaggatt

SEQ ID NO: 32159 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaaggatt

SEQ ID NO: 32160 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaaggatt

SEQ ID NO: 32161 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaaggatt

SEQ ID NO: 32162 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaaggatt

SEQ ID NO: 32163 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaaggatt

SEQ ID NO: 32164 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaaggatt

SEQ ID NO: 32165 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaaggatt

SEQ ID NO: 32166 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaaggatt

SEQ ID NO: 32167 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaaggatt

SEQ ID NO: 32168 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaaggatt

SEQ ID NO: 32169 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaaggatt

SEQ ID NO: 32170 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaaggatt

SEQ ID NO: 32171 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaaggatt

SEQ ID NO: 32172 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaaggatt

SEQ ID NO: 32173 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaaggatt

SEQ ID NO: 32174 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaaggatt

SEQ ID NO: 32175 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaaggatt

SEQ ID NO: 32176 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaaggatt

SEQ ID NO: 32177 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaaggatt

SEQ ID NO: 32178 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaaggatt

SEQ ID NO: 32179 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaaggatt

SEQ ID NO: 32180 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaaggatt

SEQ ID NO: 32181 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaaggatt

SEQ ID NO: 32182 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaaggatt

SEQ ID NO: 32183 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaaggatt

SEQ ID NO: 32184 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggatt

SEQ ID NO: 32185 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggatt

SEQ ID NO: 32186 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggatt

SEQ ID NO: 32187 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggatt

SEQ ID NO: 32188 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggatt

SEQ ID NO: 32189 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggatt

SEQ ID NO: 32190 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggatt

SEQ ID NO: 32191 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggatt

SEQ ID NO: 32192 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggatt

SEQ ID NO: 32193 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggatt

SEQ ID NO: 32194 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggatt

SEQ ID NO: 32195 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggatt

SEQ ID NO: 32196 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggatt

SEQ ID NO: 32197 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggatt

SEQ ID NO: 32198 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggatt

SEQ ID NO: 32199 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggatt

SEQ ID NO: 32200 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggatt

SEQ ID NO: 32201 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggatt

SEQ ID NO: 32202 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggatt

SEQ ID NO: 32203 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggatt

SEQ ID NO: 32204 - DNA, 186 bp, synthetic construct
  source 1..186: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggatt

SEQ ID NO: 32205 - DNA, 187 bp, synthetic construct
  source 1..187: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggatt

SEQ ID NO: 32206 - DNA, 188 bp, synthetic construct
  source 1..188: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggatt

SEQ ID NO: 32207 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaaggattg

SEQ ID NO: 32208 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaaggattg

SEQ ID NO: 32209 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaaggattg

SEQ ID NO: 32210 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaaggattg

SEQ ID NO: 32211 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaaggattg

SEQ ID NO: 32212 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaaggattg

SEQ ID NO: 32213 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaaggattg

SEQ ID NO: 32214 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaaggattg

SEQ ID NO: 32215 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaaggattg

SEQ ID NO: 32216 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaaggattg

SEQ ID NO: 32217 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaaggattg

SEQ ID NO: 32218 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaaggattg

SEQ ID NO: 32219 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaaggattg

SEQ ID NO: 32220 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaaggattg

SEQ ID NO: 32221 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaaggattg

SEQ ID NO: 32222 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaaggattg

SEQ ID NO: 32223 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaaggattg

SEQ ID NO: 32224 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaaggattg

SEQ ID NO: 32225 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaaggattg

SEQ ID NO: 32226 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaaggattg

SEQ ID NO: 32227 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaaggattg

SEQ ID NO: 32228 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaaggattg

SEQ ID NO: 32229 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaaggattg

SEQ ID NO: 32230 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaaggattg

SEQ ID NO: 32231 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaaggattg

SEQ ID NO: 32232 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaaggattg

SEQ ID NO: 32233 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattg

SEQ ID NO: 32234 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattg

SEQ ID NO: 32235 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattg

SEQ ID NO: 32236 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattg

SEQ ID NO: 32237 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattg

SEQ ID NO: 32238 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattg

SEQ ID NO: 32239 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattg

SEQ ID NO: 32240 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattg

SEQ ID NO: 32241 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattg

SEQ ID NO: 32242 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattg

SEQ ID NO: 32243 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattg

SEQ ID NO: 32244 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattg

SEQ ID NO: 32245 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattg

SEQ ID NO: 32246 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattg

SEQ ID NO: 32247 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattg

SEQ ID NO: 32248 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattg

SEQ ID NO: 32249 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattg

SEQ ID NO: 32250 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattg

SEQ ID NO: 32251 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattg

SEQ ID NO: 32252 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattg

SEQ ID NO: 32253 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattg

SEQ ID NO: 32254 - DNA, 186 bp, synthetic construct
  source 1..186: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattg

SEQ ID NO: 32255 - DNA, 187 bp, synthetic construct
  source 1..187: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattg

SEQ ID NO: 32256 - DNA, 188 bp, synthetic construct
  source 1..188: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattg

SEQ ID NO: 32257 - DNA, 189 bp, synthetic construct
  source 1..189: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattg

SEQ ID NO: 32258 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaaggattga

SEQ ID NO: 32259 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaaggattga

SEQ ID NO: 32260 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaaggattga

SEQ ID NO: 32261 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaaggattga

SEQ ID NO: 32262 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaaggattga

SEQ ID NO: 32263 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaaggattga

SEQ ID NO: 32264 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaaggattga

SEQ ID NO: 32265 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaaggattga

SEQ ID NO: 32266 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaaggattga

SEQ ID NO: 32267 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaaggattga

SEQ ID NO: 32268 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaaggattga

SEQ ID NO: 32269 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaaggattga

SEQ ID NO: 32270 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaaggattga

SEQ ID NO: 32271 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaaggattga

SEQ ID NO: 32272 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaaggattga

SEQ ID NO: 32273 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaaggattga

SEQ ID NO: 32274 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaaggattga

SEQ ID NO: 32275 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaaggattga

SEQ ID NO: 32276 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaaggattga

SEQ ID NO: 32277 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaaggattga

SEQ ID NO: 32278 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaaggattga

SEQ ID NO: 32279 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaaggattga

SEQ ID NO: 32280 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaaggattga

SEQ ID NO: 32281 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaaggattga

SEQ ID NO: 32282 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaaggattga

SEQ ID NO: 32283 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaaggattga

SEQ ID NO: 32284 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattga

SEQ ID NO: 32285 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattga

SEQ ID NO: 32286 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattga

SEQ ID NO: 32287 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattga

SEQ ID NO: 32288 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattga

SEQ ID NO: 32289 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattga

SEQ ID NO: 32290 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattga

SEQ ID NO: 32291 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattga

SEQ ID NO: 32292 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattga

SEQ ID NO: 32293 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattga

SEQ ID NO: 32294 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattga

SEQ ID NO: 32295 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattga

SEQ ID NO: 32296 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattga

SEQ ID NO: 32297 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattga

SEQ ID NO: 32298 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattga

SEQ ID NO: 32299 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattga

SEQ ID NO: 32300 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattga

SEQ ID NO: 32301 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattga

SEQ ID NO: 32302 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattga

SEQ ID NO: 32303 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattga

SEQ ID NO: 32304 - DNA, 186 bp, synthetic construct
  source 1..186: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattga

SEQ ID NO: 32305 - DNA, 187 bp, synthetic construct
  source 1..187: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattga

SEQ ID NO: 32306 - DNA, 188 bp, synthetic construct
  source 1..188: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattga

SEQ ID NO: 32307 - DNA, 189 bp, synthetic construct
  source 1..189: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattga

SEQ ID NO: 32308 - DNA, 190 bp, synthetic construct
  source 1..190: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattga

SEQ ID NO: 32309 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaaggattgag

SEQ ID NO: 32310 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaaggattgag

SEQ ID NO: 32311 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaaggattgag

SEQ ID NO: 32312 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaaggattgag

SEQ ID NO: 32313 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaaggattgag

SEQ ID NO: 32314 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaaggattgag

SEQ ID NO: 32315 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaaggattgag

SEQ ID NO: 32316 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaaggattgag

SEQ ID NO: 32317 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaaggattgag

SEQ ID NO: 32318 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaaggattgag

SEQ ID NO: 32319 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaaggattgag

SEQ ID NO: 32320 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaaggattgag

SEQ ID NO: 32321 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaaggattgag

SEQ ID NO: 32322 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaaggattgag

SEQ ID NO: 32323 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaaggattgag

SEQ ID NO: 32324 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaaggattgag

SEQ ID NO: 32325 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaaggattgag

SEQ ID NO: 32326 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaaggattgag

SEQ ID NO: 32327 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaaggattgag

SEQ ID NO: 32328 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaaggattgag

SEQ ID NO: 32329 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaaggattgag

SEQ ID NO: 32330 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaaggattgag

SEQ ID NO: 32331 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaaggattgag

SEQ ID NO: 32332 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaaggattgag

SEQ ID NO: 32333 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaaggattgag

SEQ ID NO: 32334 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaaggattgag

SEQ ID NO: 32335 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattgag

SEQ ID NO: 32336 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattgag

SEQ ID NO: 32337 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattgag

SEQ ID NO: 32338 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattgag

SEQ ID NO: 32339 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattgag

SEQ ID NO: 32340 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattgag

SEQ ID NO: 32341 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattgag

SEQ ID NO: 32342 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattgag

SEQ ID NO: 32343 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattgag

SEQ ID NO: 32344 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattgag

SEQ ID NO: 32345 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattgag

SEQ ID NO: 32346 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattgag

SEQ ID NO: 32347 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattgag

SEQ ID NO: 32348 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattgag

SEQ ID NO: 32349 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattgag

SEQ ID NO: 32350 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattgag

SEQ ID NO: 32351 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattgag

SEQ ID NO: 32352 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattgag

SEQ ID NO: 32353 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattgag

SEQ ID NO: 32354 - DNA, 186 bp, synthetic construct
  source 1..186: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattgag

SEQ ID NO: 32355 - DNA, 187 bp, synthetic construct
  source 1..187: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattgag

SEQ ID NO: 32356 - DNA, 188 bp, synthetic construct
  source 1..188: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattgag

SEQ ID NO: 32357 - DNA, 189 bp, synthetic construct
  source 1..189: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattgag

SEQ ID NO: 32358 - DNA, 190 bp, synthetic construct
  source 1..190: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattgag

SEQ ID NO: 32359 - DNA, 191 bp, synthetic construct
  source 1..191: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattgag

SEQ ID NO: 32360 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaaggattgagg

SEQ ID NO: 32361 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaaggattgagg

SEQ ID NO: 32362 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaaggattgagg

SEQ ID NO: 32363 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaaggattgagg

SEQ ID NO: 32364 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaaggattgagg

SEQ ID NO: 32365 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaaggattgagg

SEQ ID NO: 32366 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaaggattgagg

SEQ ID NO: 32367 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaaggattgagg

SEQ ID NO: 32368 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaaggattgagg

SEQ ID NO: 32369 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaaggattgagg

SEQ ID NO: 32370 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaaggattgagg

SEQ ID NO: 32371 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaaggattgagg

SEQ ID NO: 32372 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaaggattgagg

SEQ ID NO: 32373 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaaggattgagg

SEQ ID NO: 32374 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaaggattgagg

SEQ ID NO: 32375 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaaggattgagg

SEQ ID NO: 32376 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaaggattgagg

SEQ ID NO: 32377 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaaggattgagg

SEQ ID NO: 32378 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaaggattgagg

SEQ ID NO: 32379 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaaggattgagg

SEQ ID NO: 32380 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaaggattgagg

SEQ ID NO: 32381 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaaggattgagg

SEQ ID NO: 32382 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaaggattgagg

SEQ ID NO: 32383 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaaggattgagg

SEQ ID NO: 32384 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaaggattgagg

SEQ ID NO: 32385 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaaggattgagg

SEQ ID NO: 32386 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaaggattgagg

SEQ ID NO: 32387 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaaggattgagg

SEQ ID NO: 32388 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaaggattgagg

SEQ ID NO: 32389 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaaggattgagg

SEQ ID NO: 32390 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaaggattgagg

SEQ ID NO: 32391 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaaggattgagg

SEQ ID NO: 32392 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaaggattgagg

SEQ ID NO: 32393 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaaggattgagg

SEQ ID NO: 32394 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaaggattgagg

SEQ ID NO: 32395 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaaggattgagg

SEQ ID NO: 32396 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaaggattgagg

SEQ ID NO: 32397 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaaggattgagg

SEQ ID NO: 32398 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaaggattgagg

SEQ ID NO: 32399 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaaggattgagg

SEQ ID NO: 32400 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaaggattgagg

SEQ ID NO: 32401 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaaggattgagg

SEQ ID NO: 32402 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaaggattgagg

SEQ ID NO: 32403 - DNA, 185 bp, synthetic construct
  source 1..185: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaaggattgagg

SEQ ID NO: 32404 - DNA, 186 bp, synthetic construct
  source 1..186: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaaggattgagg

SEQ ID NO: 32405 - DNA, 187 bp, synthetic construct
  source 1..187: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaaggattgagg

SEQ ID NO: 32406 - DNA, 188 bp, synthetic construct
  source 1..188: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaaggattgagg

SEQ ID NO: 32407 - DNA, 189 bp, synthetic construct
  source 1..189: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaaggattgagg

SEQ ID NO: 32408 - DNA, 190 bp, synthetic construct
  source 1..190: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaaggattgagg

SEQ ID NO: 32409 - DNA, 191 bp, synthetic construct
  source 1..191: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaaggattgagg

SEQ ID NO: 32410 - DNA, 192 bp, synthetic construct
  source 1..192: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaaggattgagg

SEQ ID NO: 32411 - DNA, 126 bp, synthetic construct
  source 1..126: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatac

SEQ ID NO: 32412 - DNA, 127 bp, synthetic construct
  source 1..127: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatac

SEQ ID NO: 32413 - DNA, 128 bp, synthetic construct
  source 1..128: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatac

SEQ ID NO: 32414 - DNA, 129 bp, synthetic construct
  source 1..129: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatac

SEQ ID NO: 32415 - DNA, 130 bp, synthetic construct
  source 1..130: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatac

SEQ ID NO: 32416 - DNA, 131 bp, synthetic construct
  source 1..131: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatac

SEQ ID NO: 32417 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatac

SEQ ID NO: 32418 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatac

SEQ ID NO: 32419 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatac

SEQ ID NO: 32420 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatac

SEQ ID NO: 32421 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatac

SEQ ID NO: 32422 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatac

SEQ ID NO: 32423 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatac

SEQ ID NO: 32424 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatac

SEQ ID NO: 32425 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatac

SEQ ID NO: 32426 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatac

SEQ ID NO: 32427 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatac

SEQ ID NO: 32428 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatac

SEQ ID NO: 32429 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatac

SEQ ID NO: 32430 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatac

SEQ ID NO: 32431 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatac

SEQ ID NO: 32432 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatac

SEQ ID NO: 32433 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatac

SEQ ID NO: 32434 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatac

SEQ ID NO: 32435 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatac

SEQ ID NO: 32436 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatac

SEQ ID NO: 32437 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatac

SEQ ID NO: 32438 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatac

SEQ ID NO: 32439 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatac

SEQ ID NO: 32440 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatac

SEQ ID NO: 32441 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatac

SEQ ID NO: 32442 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatac

SEQ ID NO: 32443 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatac

SEQ ID NO: 32444 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatac

SEQ ID NO: 32445 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatac

SEQ ID NO: 32446 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatac

SEQ ID NO: 32447 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatac

SEQ ID NO: 32448 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatac

SEQ ID NO: 32449 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatac

SEQ ID NO: 32450 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatac

SEQ ID NO: 32451 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatac

SEQ ID NO: 32452 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatac

SEQ ID NO: 32453 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatac

SEQ ID NO: 32454 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatac

SEQ ID NO: 32455 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatac

SEQ ID NO: 32456 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatac

SEQ ID NO: 32457 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatac

SEQ ID NO: 32458 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatac

SEQ ID NO: 32459 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatac

SEQ ID NO: 32460 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatac

SEQ ID NO: 32461 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatac

SEQ ID NO: 32462 - DNA, 127 bp, synthetic construct
  source 1..127: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccataca

SEQ ID NO: 32463 - DNA, 128 bp, synthetic construct
  source 1..128: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccataca

SEQ ID NO: 32464 - DNA, 129 bp, synthetic construct
  source 1..129: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccataca

SEQ ID NO: 32465 - DNA, 130 bp, synthetic construct
  source 1..130: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccataca

SEQ ID NO: 32466 - DNA, 131 bp, synthetic construct
  source 1..131: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccataca

SEQ ID NO: 32467 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccataca

SEQ ID NO: 32468 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccataca

SEQ ID NO: 32469 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccataca

SEQ ID NO: 32470 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccataca

SEQ ID NO: 32471 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccataca

SEQ ID NO: 32472 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccataca

SEQ ID NO: 32473 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccataca

SEQ ID NO: 32474 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccataca

SEQ ID NO: 32475 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccataca

SEQ ID NO: 32476 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccataca

SEQ ID NO: 32477 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccataca

SEQ ID NO: 32478 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccataca

SEQ ID NO: 32479 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccataca

SEQ ID NO: 32480 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccataca

SEQ ID NO: 32481 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccataca

SEQ ID NO: 32482 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccataca

SEQ ID NO: 32483 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccataca

SEQ ID NO: 32484 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccataca

SEQ ID NO: 32485 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccataca

SEQ ID NO: 32486 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccataca

SEQ ID NO: 32487 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccataca

SEQ ID NO: 32488 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccataca

SEQ ID NO: 32489 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccataca

SEQ ID NO: 32490 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccataca

SEQ ID NO: 32491 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccataca

SEQ ID NO: 32492 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccataca

SEQ ID NO: 32493 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccataca

SEQ ID NO: 32494 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccataca

SEQ ID NO: 32495 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccataca

SEQ ID NO: 32496 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccataca

SEQ ID NO: 32497 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccataca

SEQ ID NO: 32498 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccataca

SEQ ID NO: 32499 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccataca

SEQ ID NO: 32500 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccataca

SEQ ID NO: 32501 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccataca

SEQ ID NO: 32502 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccataca

SEQ ID NO: 32503 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccataca

SEQ ID NO: 32504 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccataca

SEQ ID NO: 32505 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccataca

SEQ ID NO: 32506 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccataca

SEQ ID NO: 32507 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccataca

SEQ ID NO: 32508 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccataca

SEQ ID NO: 32509 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccataca

SEQ ID NO: 32510 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccataca

SEQ ID NO: 32511 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccataca

SEQ ID NO: 32512 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccataca

SEQ ID NO: 32513 - DNA, 128 bp, synthetic construct
  source 1..128: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacac

SEQ ID NO: 32514 - DNA, 129 bp, synthetic construct
  source 1..129: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacac

SEQ ID NO: 32515 - DNA, 130 bp, synthetic construct
  source 1..130: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacac

SEQ ID NO: 32516 - DNA, 131 bp, synthetic construct
  source 1..131: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacac

SEQ ID NO: 32517 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacac

SEQ ID NO: 32518 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacac

SEQ ID NO: 32519 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacac

SEQ ID NO: 32520 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacac

SEQ ID NO: 32521 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacac

SEQ ID NO: 32522 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacac

SEQ ID NO: 32523 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacac

SEQ ID NO: 32524 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacac

SEQ ID NO: 32525 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacac

SEQ ID NO: 32526 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacac

SEQ ID NO: 32527 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacac

SEQ ID NO: 32528 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacac

SEQ ID NO: 32529 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacac

SEQ ID NO: 32530 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacac

SEQ ID NO: 32531 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacac

SEQ ID NO: 32532 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacac

SEQ ID NO: 32533 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacac

SEQ ID NO: 32534 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacac

SEQ ID NO: 32535 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacac

SEQ ID NO: 32536 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacac

SEQ ID NO: 32537 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacac

SEQ ID NO: 32538 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacac

SEQ ID NO: 32539 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacac

SEQ ID NO: 32540 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacac

SEQ ID NO: 32541 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacac

SEQ ID NO: 32542 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacac

SEQ ID NO: 32543 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacac

SEQ ID NO: 32544 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacac

SEQ ID NO: 32545 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacac

SEQ ID NO: 32546 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacac

SEQ ID NO: 32547 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacac

SEQ ID NO: 32548 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacac

SEQ ID NO: 32549 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacac

SEQ ID NO: 32550 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacac

SEQ ID NO: 32551 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacac

SEQ ID NO: 32552 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacac

SEQ ID NO: 32553 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacac

SEQ ID NO: 32554 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacac

SEQ ID NO: 32555 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacac

SEQ ID NO: 32556 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacac

SEQ ID NO: 32557 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacac

SEQ ID NO: 32558 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacac

SEQ ID NO: 32559 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacac

SEQ ID NO: 32560 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacac

SEQ ID NO: 32561 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacac

SEQ ID NO: 32562 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacac

SEQ ID NO: 32563 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacac

SEQ ID NO: 32564 - DNA, 129 bp, synthetic construct
  source 1..129: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacc

SEQ ID NO: 32565 - DNA, 130 bp, synthetic construct
  source 1..130: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacc

SEQ ID NO: 32566 - DNA, 131 bp, synthetic construct
  source 1..131: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacc

SEQ ID NO: 32567 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacc

SEQ ID NO: 32568 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacc

SEQ ID NO: 32569 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacc

SEQ ID NO: 32570 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacc

SEQ ID NO: 32571 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacc

SEQ ID NO: 32572 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacc

SEQ ID NO: 32573 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacc

SEQ ID NO: 32574 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacc

SEQ ID NO: 32575 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacc

SEQ ID NO: 32576 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacc

SEQ ID NO: 32577 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacc

SEQ ID NO: 32578 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacc

SEQ ID NO: 32579 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacc

SEQ ID NO: 32580 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacc

SEQ ID NO: 32581 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacc

SEQ ID NO: 32582 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacc

SEQ ID NO: 32583 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacc

SEQ ID NO: 32584 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacc

SEQ ID NO: 32585 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacc

SEQ ID NO: 32586 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacc

SEQ ID NO: 32587 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacc

SEQ ID NO: 32588 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacc

SEQ ID NO: 32589 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacc

SEQ ID NO: 32590 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacc

SEQ ID NO: 32591 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacc

SEQ ID NO: 32592 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacc

SEQ ID NO: 32593 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacc

SEQ ID NO: 32594 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacc

SEQ ID NO: 32595 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacc

SEQ ID NO: 32596 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacc

SEQ ID NO: 32597 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacc

SEQ ID NO: 32598 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacc

SEQ ID NO: 32599 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacc

SEQ ID NO: 32600 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacc

SEQ ID NO: 32601 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacc

SEQ ID NO: 32602 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacc

SEQ ID NO: 32603 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacc

SEQ ID NO: 32604 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacc

SEQ ID NO: 32605 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacc

SEQ ID NO: 32606 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacc

SEQ ID NO: 32607 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacc

SEQ ID NO: 32608 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacc

SEQ ID NO: 32609 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacc

SEQ ID NO: 32610 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacc

SEQ ID NO: 32611 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacc

SEQ ID NO: 32612 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacc

SEQ ID NO: 32613 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacc

SEQ ID NO: 32614 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacc

SEQ ID NO: 32615 - DNA, 130 bp, synthetic construct
  source 1..130: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacaccc

SEQ ID NO: 32616 - DNA, 131 bp, synthetic construct
  source 1..131: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacaccc

SEQ ID NO: 32617 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacaccc

SEQ ID NO: 32618 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacaccc

SEQ ID NO: 32619 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacaccc

SEQ ID NO: 32620 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacaccc

SEQ ID NO: 32621 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacaccc

SEQ ID NO: 32622 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacaccc

SEQ ID NO: 32623 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacaccc

SEQ ID NO: 32624 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacaccc

SEQ ID NO: 32625 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacaccc

SEQ ID NO: 32626 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacaccc

SEQ ID NO: 32627 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacaccc

SEQ ID NO: 32628 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacaccc

SEQ ID NO: 32629 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacaccc

SEQ ID NO: 32630 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacaccc

SEQ ID NO: 32631 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacaccc

SEQ ID NO: 32632 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacaccc

SEQ ID NO: 32633 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacaccc

SEQ ID NO: 32634 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacaccc

SEQ ID NO: 32635 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacaccc

SEQ ID NO: 32636 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacaccc

SEQ ID NO: 32637 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacaccc

SEQ ID NO: 32638 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacaccc

SEQ ID NO: 32639 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacaccc

SEQ ID NO: 32640 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacaccc

SEQ ID NO: 32641 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacaccc

SEQ ID NO: 32642 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacaccc

SEQ ID NO: 32643 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacaccc

SEQ ID NO: 32644 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacaccc

SEQ ID NO: 32645 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacaccc

SEQ ID NO: 32646 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacaccc

SEQ ID NO: 32647 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacaccc

SEQ ID NO: 32648 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacaccc

SEQ ID NO: 32649 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacaccc

SEQ ID NO: 32650 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacaccc

SEQ ID NO: 32651 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacaccc

SEQ ID NO: 32652 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacaccc

SEQ ID NO: 32653 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacaccc

SEQ ID NO: 32654 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacaccc

SEQ ID NO: 32655 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacaccc

SEQ ID NO: 32656 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacaccc

SEQ ID NO: 32657 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacaccc

SEQ ID NO: 32658 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacaccc

SEQ ID NO: 32659 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacaccc

SEQ ID NO: 32660 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacaccc

SEQ ID NO: 32661 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacaccc

SEQ ID NO: 32662 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacaccc

SEQ ID NO: 32663 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacaccc

SEQ ID NO: 32664 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacaccc

SEQ ID NO: 32665 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacaccc

SEQ ID NO: 32666 - DNA, 131 bp, synthetic construct
  source 1..131: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacaccca

SEQ ID NO: 32667 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacaccca

SEQ ID NO: 32668 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacaccca

SEQ ID NO: 32669 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacaccca

SEQ ID NO: 32670 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacaccca

SEQ ID NO: 32671 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacaccca

SEQ ID NO: 32672 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacaccca

SEQ ID NO: 32673 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacaccca

SEQ ID NO: 32674 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacaccca

SEQ ID NO: 32675 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacaccca

SEQ ID NO: 32676 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacaccca

SEQ ID NO: 32677 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacaccca

SEQ ID NO: 32678 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacaccca

SEQ ID NO: 32679 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacaccca

SEQ ID NO: 32680 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacaccca

SEQ ID NO: 32681 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacaccca

SEQ ID NO: 32682 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacaccca

SEQ ID NO: 32683 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacaccca

SEQ ID NO: 32684 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacaccca

SEQ ID NO: 32685 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacaccca

SEQ ID NO: 32686 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacaccca

SEQ ID NO: 32687 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacaccca

SEQ ID NO: 32688 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacaccca

SEQ ID NO: 32689 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacaccca

SEQ ID NO: 32690 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacaccca

SEQ ID NO: 32691 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacaccca

SEQ ID NO: 32692 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacaccca

SEQ ID NO: 32693 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacaccca

SEQ ID NO: 32694 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacaccca

SEQ ID NO: 32695 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacaccca

SEQ ID NO: 32696 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacaccca

SEQ ID NO: 32697 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacaccca

SEQ ID NO: 32698 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacaccca

SEQ ID NO: 32699 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacaccca

SEQ ID NO: 32700 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacaccca

SEQ ID NO: 32701 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacaccca

SEQ ID NO: 32702 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacaccca

SEQ ID NO: 32703 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacaccca

SEQ ID NO: 32704 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacaccca

SEQ ID NO: 32705 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacaccca

SEQ ID NO: 32706 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacaccca

SEQ ID NO: 32707 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacaccca

SEQ ID NO: 32708 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacaccca

SEQ ID NO: 32709 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacaccca

SEQ ID NO: 32710 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacaccca

SEQ ID NO: 32711 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacaccca

SEQ ID NO: 32712 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacaccca

SEQ ID NO: 32713 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacaccca

SEQ ID NO: 32714 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacaccca

SEQ ID NO: 32715 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacaccca

SEQ ID NO: 32716 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacaccca

SEQ ID NO: 32717 - DNA, 132 bp, synthetic construct
  source 1..132: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaa

SEQ ID NO: 32718 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaa

SEQ ID NO: 32719 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaa

SEQ ID NO: 32720 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaa

SEQ ID NO: 32721 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaa

SEQ ID NO: 32722 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaa

SEQ ID NO: 32723 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaa

SEQ ID NO: 32724 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaa

SEQ ID NO: 32725 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaa

SEQ ID NO: 32726 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaa

SEQ ID NO: 32727 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaa

SEQ ID NO: 32728 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaa

SEQ ID NO: 32729 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaa

SEQ ID NO: 32730 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaa

SEQ ID NO: 32731 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaa

SEQ ID NO: 32732 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaa

SEQ ID NO: 32733 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaa

SEQ ID NO: 32734 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaa

SEQ ID NO: 32735 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaa

SEQ ID NO: 32736 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaa

SEQ ID NO: 32737 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaa

SEQ ID NO: 32738 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaa

SEQ ID NO: 32739 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaa

SEQ ID NO: 32740 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaa

SEQ ID NO: 32741 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaa

SEQ ID NO: 32742 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaa

SEQ ID NO: 32743 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaa

SEQ ID NO: 32744 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaa

SEQ ID NO: 32745 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaa

SEQ ID NO: 32746 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaa

SEQ ID NO: 32747 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaa

SEQ ID NO: 32748 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaa

SEQ ID NO: 32749 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaa

SEQ ID NO: 32750 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaa

SEQ ID NO: 32751 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaa

SEQ ID NO: 32752 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaa

SEQ ID NO: 32753 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaa

SEQ ID NO: 32754 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaa

SEQ ID NO: 32755 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaa

SEQ ID NO: 32756 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaa

SEQ ID NO: 32757 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaa

SEQ ID NO: 32758 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaa

SEQ ID NO: 32759 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaa

SEQ ID NO: 32760 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaa

SEQ ID NO: 32761 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaa

SEQ ID NO: 32762 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaa

SEQ ID NO: 32763 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaa

SEQ ID NO: 32764 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaa

SEQ ID NO: 32765 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaa

SEQ ID NO: 32766 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaa

SEQ ID NO: 32767 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaa

SEQ ID NO: 32768 - DNA, 133 bp, synthetic construct
  source 1..133: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaa

SEQ ID NO: 32769 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaa

SEQ ID NO: 32770 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaa

SEQ ID NO: 32771 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaa

SEQ ID NO: 32772 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaa

SEQ ID NO: 32773 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaa

SEQ ID NO: 32774 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaa

SEQ ID NO: 32775 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaa

SEQ ID NO: 32776 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaa

SEQ ID NO: 32777 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaa

SEQ ID NO: 32778 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaa

SEQ ID NO: 32779 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaa

SEQ ID NO: 32780 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaa

SEQ ID NO: 32781 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaa

SEQ ID NO: 32782 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaa

SEQ ID NO: 32783 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaa

SEQ ID NO: 32784 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaa

SEQ ID NO: 32785 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaa

SEQ ID NO: 32786 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaa

SEQ ID NO: 32787 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaa

SEQ ID NO: 32788 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaa

SEQ ID NO: 32789 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaa

SEQ ID NO: 32790 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaa

SEQ ID NO: 32791 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaa

SEQ ID NO: 32792 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaa

SEQ ID NO: 32793 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaa

SEQ ID NO: 32794 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaa

SEQ ID NO: 32795 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaa

SEQ ID NO: 32796 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaa

SEQ ID NO: 32797 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaa

SEQ ID NO: 32798 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaa

SEQ ID NO: 32799 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaa

SEQ ID NO: 32800 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaa

SEQ ID NO: 32801 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaa

SEQ ID NO: 32802 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaa

SEQ ID NO: 32803 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaa

SEQ ID NO: 32804 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaa

SEQ ID NO: 32805 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaa

SEQ ID NO: 32806 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaa

SEQ ID NO: 32807 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaa

SEQ ID NO: 32808 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaa

SEQ ID NO: 32809 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaa

SEQ ID NO: 32810 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaa

SEQ ID NO: 32811 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaa

SEQ ID NO: 32812 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaa

SEQ ID NO: 32813 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaa

SEQ ID NO: 32814 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaa

SEQ ID NO: 32815 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaa

SEQ ID NO: 32816 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaa

SEQ ID NO: 32817 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaa

SEQ ID NO: 32818 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaa

SEQ ID NO: 32819 - DNA, 134 bp, synthetic construct
  source 1..134: mol_type = other DNA
cctcaatcctttgggtgtatgttttagagctagaaatagcaagttaaaataaggctagtccgttatcaacttgaaaaagtggcaccgagtcggtgccggcccttctcagttcgctacgacccatacacccaaag

SEQ ID NO: 32820 - DNA, 135 bp, synthetic construct
  source 1..135: mol_type = other DNA
cctcaatcctttgggtgtatgttttagagctagaaatagcaagttaaaataaggctagtccgttatcaacttgaaaaagtggcaccgagtcggtgctcggcccttctcagttcgctacgacccatacacccaaag

SEQ ID NO: 32821 - DNA, 136 bp, synthetic construct
  source 1..136: mol_type = other DNA
cctcaatcctttgggtgtatgttttagagctagaaatagcaagttaaaataaggctagtccgttatcaacttgaaaaagtggcaccgagtcggtgcctcggcccttctcagttcgctacgacccatacacccaaag

SEQ ID NO: 32822 - DNA, 137 bp, synthetic construct
  source 1..137: mol_type = other DNA
cctcaatcctttgggtgtatgttttagagctagaaatagcaagttaaaataaggctagtccgttatcaacttgaaaaagtggcaccgagtcggtgccctcggcccttctcagttcgctacgacccatacacccaaag

SEQ ID NO: 32823 - DNA, 138 bp, synthetic construct
  source 1..138: mol_type = other DNA
cctcaatcctttgggtgtatgttttagagctagaaatagcaagttaaaataaggctagtccgttatcaacttgaaaaagtggcaccgagtcggtgcacctcggcccttctcagttcgctacgacccatacacccaaag

SEQ ID NO: 32824 - DNA, 139 bp, synthetic construct
  source 1..139: mol_type = other DNA
cctcaatcctttgggtgtatgttttagagctagaaatagcaagttaaaataaggctagtccgttatcaacttgaaaaagtggcaccgagtcggtgctacctcggcccttctcagttcgctacgacccatacacccaaag

SEQ ID NO: 32825 - DNA, 140 bp, synthetic construct
  source 1..140: mol_type = other DNA
cctcaatcctttgggtgtatgttttagagctagaaatagcaagttaaaataaggctagtccgttatcaacttgaaaaagtggcaccgagtcggtgcatacctcggcccttctcagttcgctacgacccatacacccaaag

SEQ ID NO: 32826 - DNA, 141 bp, synthetic construct
  source 1..141: mol_type = other DNA
cctcaatcctttgggtgtatgttttagagctagaaatagcaagttaaaataaggctagtccgttatcaacttgaaaaagtggcaccgagtcggtgcaatacctcggcccttctcagttcgctacgacccatacacccaaag

SEQ ID NO: 32827 - DNA, 142 bp, synthetic construct
  source 1..142: mol_type = other DNA
cctcaatcctttgggtgtatgttttagagctagaaatagcaagttaaaataaggctagtccgttatcaacttgaaaaagtggcaccgagtcggtgccaatacctcggcccttctcagttcgctacgacccatacacccaaag

SEQ ID NO: 32828 - DNA, 143 bp, synthetic construct
  source 1..143: mol_type = other DNA
cctcaatcctttgggtgtatgttttagagctagaaatagcaagttaaaataaggctagtccgttatcaacttgaaaaagtggcaccgagtcggtgcacaatacctcggcccttctcagttcgctacgacccatacacccaaag

SEQ ID NO: 32829 - DNA, 144 bp, synthetic construct
  source 1..144: mol_type = other DNA
cctcaatcctttgggtgtatgttttagagctagaaatagcaagttaaaataaggctagtccgttatcaacttgaaaaagtggcaccgagtcggtgccacaatacctcggcccttctcagttcgctacgacccatacacccaaag

SEQ ID NO: 32830 - DNA, 145 bp, synthetic construct
  source 1..145: mol_type = other DNA
cctcaatcctttgggtgtatgttttagagctagaaatagcaagttaaaataaggctagtccgttatcaacttgaaaaagtggcaccgagtcggtgcccacaatacctcggcccttctcagttcgctacgacccatacacccaaag

SEQ ID NO: 32831 - DNA, 146 bp, synthetic construct
  source 1..146: mol_type = other DNA
cctcaatcctttgggtgtatgttttagagctagaaatagcaagttaaaataaggctagtccgttatcaacttgaaaaagtggcaccgagtcggtgcgccacaatacctcggcccttctcagttcgctacgacccatacacccaaag

SEQ ID NO: 32832 - DNA, 147 bp, synthetic construct
  source 1..147: mol_type = other DNA
cctcaatcctttgggtgtatgttttagagctagaaatagcaagttaaaataaggctagtccgttatcaacttgaaaaagtggcaccgagtcggtgctgccacaatacctcggcccttctcagttcgctacgacccatacacccaaag

SEQ ID NO: 32833 - DNA, 148 bp, synthetic construct
  source 1..148: mol_type = other DNA
cctcaatcctttgggtgtatgttttagagctagaaatagcaagttaaaataaggctagtccgttatcaacttgaaaaagtggcaccgagtcggtgcctgccacaatacctcggcccttctcagttcgctacgacccatacacccaaag

SEQ ID NO: 32834 - DNA, 149 bp, synthetic construct
  source 1..149: mol_type = other DNA
cctcaatcctttgggtgtatgttttagagctagaaatagcaagttaaaataaggctagtccgttatcaacttgaaaaagtggcaccgagtcggtgcgctgccacaatacctcggcccttctcagttcgctacgacccatacacccaaag

SEQ ID NO: 32835 - DNA, 150 bp, synthetic construct
  source 1..150: mol_type = other DNA
cctcaatcctttgggtgtatgttttagagctagaaatagcaagttaaaataaggctagtccgttatcaacttgaaaaagtggcaccgagtcggtgctgctgccacaatacctcggcccttctcagttcgctacgacccatacacccaaag

SEQ ID NO: 32836 - DNA, 151 bp, synthetic construct
  source 1..151: mol_type = other DNA
cctcaatcctttgggtgtatgttttagagctagaaatagcaagttaaaataaggctagtccgttatcaacttgaaaaagtggcaccgagtcggtgcttgctgccacaatacctcggcccttctcagttcgctacgacccatacacccaaag

SEQ ID NO: 32837 - DNA, 152 bp, synthetic construct
  source 1..152: mol_type = other DNA
cctcaatcctttgggtgtatgttttagagctagaaatagcaagttaaaataaggctagtccgttatcaacttgaaaaagtggcaccgagtcggtgctttgctgccacaatacctcggcccttctcagttcgctacgacccatacacccaaag

SEQ ID NO: 32838 - DNA, 153 bp, synthetic construct
  source 1..153: mol_type = other DNA
cctcaatcctttgggtgtatgttttagagctagaaatagcaagttaaaataaggctagtccgttatcaacttgaaaaagtggcaccgagtcggtgcctttgctgccacaatacctcggcccttctcagttcgctacgacccatacacccaaag

SEQ ID NO: 32839 - DNA, 154 bp, synthetic construct
  source 1..154: mol_type = other DNA
cctcaatcctttgggtgtatgttttagagctagaaatagcaagttaaaataaggctagtccgttatcaacttgaaaaagtggcaccgagtcggtgcactttgctgccacaatacctcggcccttctcagttcgctacgacccatacacccaaag

SEQ ID NO: 32840 - DNA, 155 bp, synthetic construct
  source 1..155: mol_type = other DNA
cctcaatcctttgggtgtatgttttagagctagaaatagcaagttaaaataaggctagtccgttatcaacttgaaaaagtggcaccgagtcggtgcaactttgctgccacaatacctcggcccttctcagttcgctacgacccatacacccaaag

SEQ ID NO: 32841 - DNA, 156 bp, synthetic construct
  source 1..156: mol_type = other DNA
cctcaatcctttgggtgtatgttttagagctagaaatagcaagttaaaataaggctagtccgttatcaacttgaaaaagtggcaccgagtcggtgcgaactttgctgccacaatacctcggcccttctcagttcgctacgacccatacacccaaag

SEQ ID NO: 32842 - DNA, 157 bp, synthetic construct
  source 1..157: mol_type = other DNA
cctcaatcctttgggtgtatgttttagagctagaaatagcaagttaaaataaggctagtccgttatcaacttgaaaaagtggcaccgagtcggtgcggaactttgctgccacaatacctcggcccttctcagttcgctacgacccatacacccaaag

SEQ ID NO: 32843 - DNA, 158 bp, synthetic construct
  source 1..158: mol_type = other DNA
cctcaatcctttgggtgtatgttttagagctagaaatagcaagttaaaataaggctagtccgttatcaacttgaaaaagtggcaccgagtcggtgcaggaactttgctgccacaatacctcggcccttctcagttcgctacgacccatacacccaaag

SEQ ID NO: 32844 - DNA, 159 bp, synthetic construct
  source 1..159: mol_type = other DNA
cctcaatcctttgggtgtatgttttagagctagaaatagcaagttaaaataaggctagtccgttatcaacttgaaaaagtggcaccgagtcggtgctaggaactttgctgccacaatacctcggcccttctcagttcgctacgacccatacacccaaag

SEQ ID NO: 32845 - DNA, 160 bp, synthetic construct
  source 1..160: mol_type = other DNA
cctcaatcctttgggtgtatgttttagagctagaaatagcaagttaaaataaggctagtccgttatcaacttgaaaaagtggcaccgagtcggtgcttaggaactttgctgccacaatacctcggcccttctcagttcgctacgacccatacacccaaag

SEQ ID NO: 32846 - DNA, 161 bp, synthetic construct
  source 1..161: mol_type = other DNA
cctcaatcctttgggtgtatgttttagagctagaaatagcaagttaaaataaggctagtccgttatcaacttgaaaaagtggcaccgagtcggtgccttaggaactttgctgccacaatacctcggcccttctcagttcgctacgacccatacacccaaag

SEQ ID NO: 32847 - DNA, 162 bp, synthetic construct
  source 1..162: mol_type = other DNA
cctcaatcctttgggtgtatgttttagagctagaaatagcaagttaaaataaggctagtccgttatcaacttgaaaaagtggcaccgagtcggtgctcttaggaactttgctgccacaatacctcggcccttctcagttcgctacgacccatacacccaaag

SEQ ID NO: 32848 - DNA, 163 bp, synthetic construct
  source 1..163: mol_type = other DNA
cctcaatcctttgggtgtatgttttagagctagaaatagcaagttaaaataaggctagtccgttatcaacttgaaaaagtggcaccgagtcggtgcgtcttaggaactttgctgccacaatacctcggcccttctcagttcgctacgacccatacacccaaag

SEQ ID NO: 32849 - DNA, 164 bp, synthetic construct
  source 1..164: mol_type = other DNA
cctcaatcctttgggtgtatgttttagagctagaaatagcaagttaaaataaggctagtccgttatcaacttgaaaaagtggcaccgagtcggtgcggtcttaggaactttgctgccacaatacctcggcccttctcagttcgctacgacccatacacccaaag

SEQ ID NO: 32850 - DNA, 165 bp, synthetic construct
  source 1..165: mol_type = other DNA
cctcaatcctttgggtgtatgttttagagctagaaatagcaagttaaaataaggctagtccgttatcaacttgaaaaagtggcaccgagtcggtgctggtcttaggaactttgctgccacaatacctcggcccttctcagttcgctacgacccatacacccaaag

SEQ ID NO: 32851 - DNA, 166 bp, synthetic construct
  source 1..166: mol_type = other DNA
cctcaatcctttgggtgtatgttttagagctagaaatagcaagttaaaataaggctagtccgttatcaacttgaaaaagtggcaccgagtcggtgcttggtcttaggaactttgctgccacaatacctcggcccttctcagttcgctacgacccatacacccaaag

SEQ ID NO: 32852 - DNA, 167 bp, synthetic construct
  source 1..167: mol_type = other DNA
cctcaatcctttgggtgtatgttttagagctagaaatagcaagttaaaataaggctagtccgttatcaacttgaaaaagtggcaccgagtcggtgctttggtcttaggaactttgctgccacaatacctcggcccttctcagttcgctacgacccatacacccaaag

SEQ ID NO: 32853 - DNA, 168 bp, synthetic construct
  source 1..168: mol_type = other DNA
cctcaatcctttgggtgtatgttttagagctagaaatagcaagttaaaataaggctagtccgttatcaacttgaaaaagtggcaccgagtcggtgcttttggtcttaggaactttgctgccacaatacctcggcccttctcagttcgctacgacccatacacccaaag

SEQ ID NO: 32854 - DNA, 169 bp, synthetic construct
  source 1..169: mol_type = other DNA
cctcaatcctttgggtgtatgttttagagctagaaatagcaagttaaaataaggctagtccgttatcaacttgaaaaagtggcaccgagtcggtgcgttttggtcttaggaactttgctgccacaatacctcggcccttctcagttcgctacgacccatacacccaaag

SEQ ID NO: 32855 - DNA, 170 bp, synthetic construct
  source 1..170: mol_type = other DNA
cctcaatcctttgggtgtatgttttagagctagaaatagcaagttaaaataaggctagtccgttatcaacttgaaaaagtggcaccgagtcggtgcggttttggtcttaggaactttgctgccacaatacctcggcccttctcagttcgctacgacccatacacccaaag

SEQ ID NO: 32856 - DNA, 171 bp, synthetic construct
  source 1..171: mol_type = other DNA
cctcaatcctttgggtgtatgttttagagctagaaatagcaagttaaaataaggctagtccgttatcaacttgaaaaagtggcaccgagtcggtgctggttttggtcttaggaactttgctgccacaatacctcggcccttctcagttcgctacgacccatacacccaaag

SEQ ID NO: 32857 - DNA, 172 bp, synthetic construct
  source 1..172: mol_type = other DNA
cctcaatcctttgggtgtatgttttagagctagaaatagcaagttaaaataaggctagtccgttatcaacttgaaaaagtggcaccgagtcggtgcgtggttttggtcttaggaactttgctgccacaatacctcggcccttctcagttcgctacgacccatacacccaaag

SEQ ID NO: 32858 - DNA, 173 bp, synthetic construct
  source 1..173: mol_type = other DNA
cctcaatcctttgggtgtatgttttagagctagaaatagcaagttaaaataaggctagtccgttatcaacttgaaaaagtggcaccgagtcggtgctgtggttttggtcttaggaactttgctgccacaatacctcggcccttctcagttcgctacgacccatacacccaaag

SEQ ID NO: 32859 - DNA, 174 bp, synthetic construct
  source 1..174: mol_type = other DNA
cctcaatcctttgggtgtatgttttagagctagaaatagcaagttaaaataaggctagtccgttatcaacttgaaaaagtggcaccgagtcggtgcctgtggttttggtcttaggaactttgctgccacaatacctcggcccttctcagttcgctacgacccatacacccaaag

SEQ ID NO: 32860 - DNA, 175 bp, synthetic construct
  source 1..175: mol_type = other DNA
cctcaatcctttgggtgtatgttttagagctagaaatagcaagttaaaataaggctagtccgttatcaacttgaaaaagtggcaccgagtcggtgccctgtggttttggtcttaggaactttgctgccacaatacctcggcccttctcagttcgctacgacccatacacccaaag

SEQ ID NO: 32861 - DNA, 176 bp, synthetic construct
  source 1..176: mol_type = other DNA
cctcaatcctttgggtgtatgttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacccatacacccaaag

SEQ ID NO: 32862 - DNA, 177 bp, synthetic construct
  source 1..177: mol_type = other DNA
cctcaatcctttgggtgtatgttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacccatacacccaaag

SEQ ID NO: 32863 - DNA, 178 bp, synthetic construct
  source 1..178: mol_type = other DNA
cctcaatcctttgggtgtatgttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacccatacacccaaag

SEQ ID NO: 32864 - DNA, 179 bp, synthetic construct
  source 1..179: mol_type = other DNA
cctcaatcctttgggtgtatgttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacccatacacccaaag

SEQ ID NO: 32865 - DNA, 180 bp, synthetic construct
  source 1..180: mol_type = other DNA
cctcaatcctttgggtgtatgttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacccatacacccaaag

SEQ ID NO: 32866 - DNA, 181 bp, synthetic construct
  source 1..181: mol_type = other DNA
cctcaatcctttgggtgtatgttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacccatacacccaaag

SEQ ID NO: 32867 - DNA, 182 bp, synthetic construct
  source 1..182: mol_type = other DNA
cctcaatcctttgggtgtatgttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacccatacacccaaag

SEQ ID NO: 32868 - DNA, 183 bp, synthetic construct
  source 1..183: mol_type = other DNA
cctcaatcctttgggtgtatgttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacccatacacccaaag

SEQ ID NO: 32869 - DNA, 184 bp, synthetic construct
  source 1..184: mol_type = other DNA
cctcaatcctttgggtgtatgttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacccatacacccaaag

SEQ ID NO: 32870 - DNA, 106 bp, synthetic construct
  source 1..106: mol_type = other DNA
tgggtcgtagcgaactgagagttttagagctagaaatagcaagttaaaataaggctagtccgttatcaacttgaaaaagtggcaccgagtcggtgccggcccttct

SEQ ID NO: 32871 - DNA, 107 bp, synthetic construct
  source 1..107: mol_type = other DNA
tgggtcgtagcgaactgagagttttagagctagaaatagcaagttaaaataaggctagtccgttatcaacttgaaaaagtggcaccgagtcggtgctcggcccttct

SEQ ID NO: 32872 - DNA, 108 bp, synthetic construct
  source 1..108: mol_type = other DNA
tgggtcgtagcgaactgagagttttagagctagaaatagcaagttaaaataaggctagtccgttatcaacttgaaaaagtggcaccgagtcggtgcctcggcccttct

SEQ ID NO: 32873 - DNA, 109 bp, synthetic construct
  source 1..109: mol_type = other DNA
tgggtcgtagcgaactgagagttttagagctagaaatagcaagttaaaataaggctagtccgttatcaacttgaaaaagtggcaccgagtcggtgccctcggcccttct

SEQ ID NO: 32874 - DNA, 110 bp, synthetic construct
  source 1..110: mol_type = other DNA
tgggtcgtagcgaactgagagttttagagctagaaatagcaagttaaaataaggctagtccgttatcaacttgaaaaagtggcaccgagtcggtgcacctcggcccttct

SEQ ID NO: 32875 - DNA, 111 bp, synthetic construct
  source 1..111: mol_type = other DNA
tgggtcgtagcgaactgagagttttagagctagaaatagcaagttaaaataaggctagtccgttatcaacttgaaaaagtggcaccgagtcggtgctacctcggcccttct

SEQ ID NO: 32876 - DNA, 112 bp, synthetic construct
  source 1..112: mol_type = other DNA
tgggtcgtagcgaactgagagttttagagctagaaatagcaagttaaaataaggctagtccgttatcaacttgaaaaagtggcaccgagtcggtgcatacctcggcccttct

SEQ ID NO: 32877 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgcaatacctcggcccttct

SEQ ID NO: 32878 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgccaatacctcggcccttct

SEQ ID NO: 32879 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgcacaatacctcggcccttct

SEQ ID NO: 32880 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgccacaatacctcggcccttct

SEQ ID NO: 32881 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgcccacaatacctcggcccttct

SEQ ID NO: 32882 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgcgccacaatacctcggcccttct

SEQ ID NO: 32883 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgctgccacaatacctcggcccttct

SEQ ID NO: 32884 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcctgccacaatacctcggcccttct

SEQ ID NO: 32885 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttct

SEQ ID NO: 32886 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttct

SEQ ID NO: 32887 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttct

SEQ ID NO: 32888 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttct

SEQ ID NO: 32889 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttct

SEQ ID NO: 32890 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttct

SEQ ID NO: 32891 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttct

SEQ ID NO: 32892 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttct

SEQ ID NO: 32893 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttct

SEQ ID NO: 32894 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttct

SEQ ID NO: 32895 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttct

SEQ ID NO: 32896 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttct

SEQ ID NO: 32897 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttct

SEQ ID NO: 32898 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttct

SEQ ID NO: 32899 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttct

SEQ ID NO: 32900 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttct

SEQ ID NO: 32901 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttct

SEQ ID NO: 32902 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttct

SEQ ID NO: 32903 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttct

SEQ ID NO: 32904 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttct

SEQ ID NO: 32905 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttct

SEQ ID NO: 32906 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttct

SEQ ID NO: 32907 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttct

SEQ ID NO: 32908 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttct

SEQ ID NO: 32909 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttct

SEQ ID NO: 32910 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttct

SEQ ID NO: 32911 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttct

SEQ ID NO: 32912 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttct

SEQ ID NO: 32913 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttct

SEQ ID NO: 32914 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttct

SEQ ID NO: 32915 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttct

SEQ ID NO: 32916 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttct

SEQ ID NO: 32917 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttct

SEQ ID NO: 32918 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttct

SEQ ID NO: 32919 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttct

SEQ ID NO: 32920 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttct

SEQ ID NO: 32921 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgccggcccttctcagttcgcta

SEQ ID NO: 32922 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgctcggcccttctcagttcgcta

SEQ ID NO: 32923 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgcctcggcccttctcagttcgcta

SEQ ID NO: 32924 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgccctcggcccttctcagttcgcta

SEQ ID NO: 32925 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcacctcggcccttctcagttcgcta

SEQ ID NO: 32926 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgctacctcggcccttctcagttcgcta

SEQ ID NO: 32927 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgcta

SEQ ID NO: 32928 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgcta

SEQ ID NO: 32929 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgcta

SEQ ID NO: 32930 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgcta

SEQ ID NO: 32931 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgcta

SEQ ID NO: 32932 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgcta

SEQ ID NO: 32933 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgcta

SEQ ID NO: 32934 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgcta

SEQ ID NO: 32935 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgcta

SEQ ID NO: 32936 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgcta

SEQ ID NO: 32937 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgcta

SEQ ID NO: 32938 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgcta

SEQ ID NO: 32939 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgcta

SEQ ID NO: 32940 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgcta

SEQ ID NO: 32941 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgcta

SEQ ID NO: 32942 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgcta

SEQ ID NO: 32943 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgcta

SEQ ID NO: 32944 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgcta

SEQ ID NO: 32945 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgcta

SEQ ID NO: 32946 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgcta

SEQ ID NO: 32947 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgcta

SEQ ID NO: 32948 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgcta

SEQ ID NO: 32949 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgcta

SEQ ID NO: 32950 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgcta

SEQ ID NO: 32951 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgcta

SEQ ID NO: 32952 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgcta

SEQ ID NO: 32953 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgcta

SEQ ID NO: 32954 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgcta

SEQ ID NO: 32955 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgcta

SEQ ID NO: 32956 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgcta

SEQ ID NO: 32957 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgcta

SEQ ID NO: 32958 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgcta

SEQ ID NO: 32959 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgcta

SEQ ID NO: 32960 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgcta

SEQ ID NO: 32961 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgcta

SEQ ID NO: 32962 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgcta

SEQ ID NO: 32963 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgcta

SEQ ID NO: 32964 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgcta

SEQ ID NO: 32965 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgcta

SEQ ID NO: 32966 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgcta

SEQ ID NO: 32967 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgcta

SEQ ID NO: 32968 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgcta

SEQ ID NO: 32969 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgcta

SEQ ID NO: 32970 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgcta

SEQ ID NO: 32971 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgcta

SEQ ID NO: 32972 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgccggcccttctcagttcgctac

SEQ ID NO: 32973 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgctcggcccttctcagttcgctac

SEQ ID NO: 32974 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgcctcggcccttctcagttcgctac

SEQ ID NO: 32975 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgccctcggcccttctcagttcgctac

SEQ ID NO: 32976 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcacctcggcccttctcagttcgctac

SEQ ID NO: 32977 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgctacctcggcccttctcagttcgctac

SEQ ID NO: 32978 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgctac

SEQ ID NO: 32979 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgctac

SEQ ID NO: 32980 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgctac

SEQ ID NO: 32981 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgctac

SEQ ID NO: 32982 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgctac

SEQ ID NO: 32983 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgctac

SEQ ID NO: 32984 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgctac

SEQ ID NO: 32985 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgctac

SEQ ID NO: 32986 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgctac

SEQ ID NO: 32987 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgctac

SEQ ID NO: 32988 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgctac

SEQ ID NO: 32989 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgctac

SEQ ID NO: 32990 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgctac

SEQ ID NO: 32991 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgctac

SEQ ID NO: 32992 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgctac

SEQ ID NO: 32993 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgctac

SEQ ID NO: 32994 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgctac

SEQ ID NO: 32995 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgctac

SEQ ID NO: 32996 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgctac

SEQ ID NO: 32997 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgctac

SEQ ID NO: 32998 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgctac

SEQ ID NO: 32999 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgctac

SEQ ID NO: 33000 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgctac

SEQ ID NO: 33001 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgctac

SEQ ID NO: 33002 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgctac

SEQ ID NO: 33003 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgctac

SEQ ID NO: 33004 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgctac

SEQ ID NO: 33005 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgctac

SEQ ID NO: 33006 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgctac

SEQ ID NO: 33007 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgctac

SEQ ID NO: 33008 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgctac

SEQ ID NO: 33009 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgctac

SEQ ID NO: 33010 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgctac

SEQ ID NO: 33011 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgctac

SEQ ID NO: 33012 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgctac

SEQ ID NO: 33013 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgctac

SEQ ID NO: 33014 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgctac

SEQ ID NO: 33015 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgctac

SEQ ID NO: 33016 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctac

SEQ ID NO: 33017 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctac

SEQ ID NO: 33018 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctac

SEQ ID NO: 33019 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctac

SEQ ID NO: 33020 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctac

SEQ ID NO: 33021 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctac

SEQ ID NO: 33022 - DNA, 167 bp, synthetic construct
  source 1..167: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctac

SEQ ID NO: 33023 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgccggcccttctcagttcgctacg

SEQ ID NO: 33024 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgctcggcccttctcagttcgctacg

SEQ ID NO: 33025 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcctcggcccttctcagttcgctacg

SEQ ID NO: 33026 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgccctcggcccttctcagttcgctacg

SEQ ID NO: 33027 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcacctcggcccttctcagttcgctacg

SEQ ID NO: 33028 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgctacctcggcccttctcagttcgctacg

SEQ ID NO: 33029 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgctacg

SEQ ID NO: 33030 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgctacg

SEQ ID NO: 33031 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgctacg

SEQ ID NO: 33032 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgctacg

SEQ ID NO: 33033 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgctacg

SEQ ID NO: 33034 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgctacg

SEQ ID NO: 33035 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgctacg

SEQ ID NO: 33036 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgctacg

SEQ ID NO: 33037 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgctacg

SEQ ID NO: 33038 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgctacg

SEQ ID NO: 33039 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgctacg

SEQ ID NO: 33040 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgctacg

SEQ ID NO: 33041 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgctacg

SEQ ID NO: 33042 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgctacg

SEQ ID NO: 33043 - DNA, 138 bp, synthetic construct; identical to SEQ ID NO: 29072
  source 1..138: mol_type = other DNA

SEQ ID NO: 33044 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgctacg

SEQ ID NO: 33045 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgctacg

SEQ ID NO: 33046 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgctacg

SEQ ID NO: 33047 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgctacg

SEQ ID NO: 33048 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgctacg

SEQ ID NO: 33049 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgctacg

SEQ ID NO: 33050 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgctacg

SEQ ID NO: 33051 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgctacg

SEQ ID NO: 33052 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgctacg

SEQ ID NO: 33053 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgctacg

SEQ ID NO: 33054 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgctacg

SEQ ID NO: 33055 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgctacg

SEQ ID NO: 33056 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgctacg

SEQ ID NO: 33057 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgctacg

SEQ ID NO: 33058 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgctacg

SEQ ID NO: 33059 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgctacg

SEQ ID NO: 33060 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgctacg

SEQ ID NO: 33061 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgctacg

SEQ ID NO: 33062 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgctacg

SEQ ID NO: 33063 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgctacg

SEQ ID NO: 33064 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgctacg

SEQ ID NO: 33065 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacg

SEQ ID NO: 33066 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacg

SEQ ID NO: 33067 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacg

SEQ ID NO: 33068 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacg

SEQ ID NO: 33069 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacg

SEQ ID NO: 33070 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacg

SEQ ID NO: 33071 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacg

SEQ ID NO: 33072 - DNA, 167 bp, synthetic construct
  source 1..167: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacg

SEQ ID NO: 33073 - DNA, 168 bp, synthetic construct
  source 1..168: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacg

SEQ ID NO: 33074 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgccggcccttctcagttcgctacga

SEQ ID NO: 33075 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgctcggcccttctcagttcgctacga

SEQ ID NO: 33076 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcctcggcccttctcagttcgctacga

SEQ ID NO: 33077 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgccctcggcccttctcagttcgctacga

SEQ ID NO: 33078 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcacctcggcccttctcagttcgctacga

SEQ ID NO: 33079 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgctacctcggcccttctcagttcgctacga

SEQ ID NO: 33080 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgctacga

SEQ ID NO: 33081 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgctacga

SEQ ID NO: 33082 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgctacga

SEQ ID NO: 33083 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgctacga

SEQ ID NO: 33084 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgctacga

SEQ ID NO: 33085 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgctacga

SEQ ID NO: 33086 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgctacga

SEQ ID NO: 33087 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgctacga

SEQ ID NO: 33088 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgctacga

SEQ ID NO: 33089 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgctacga

SEQ ID NO: 33090 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgctacga

SEQ ID NO: 33091 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgctacga

SEQ ID NO: 33092 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgctacga

SEQ ID NO: 33093 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgctacga

SEQ ID NO: 33094 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgctacga

SEQ ID NO: 33095 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgctacga

SEQ ID NO: 33096 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgctacga

SEQ ID NO: 33097 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgctacga

SEQ ID NO: 33098 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgctacga

SEQ ID NO: 33099 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgctacga

SEQ ID NO: 33100 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgctacga

SEQ ID NO: 33101 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgctacga

SEQ ID NO: 33102 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgctacga

SEQ ID NO: 33103 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgctacga

SEQ ID NO: 33104 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgctacga

SEQ ID NO: 33105 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgctacga

SEQ ID NO: 33106 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgctacga

SEQ ID NO: 33107 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgctacga

SEQ ID NO: 33108 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgctacga

SEQ ID NO: 33109 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgctacga

SEQ ID NO: 33110 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgctacga

SEQ ID NO: 33111 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgctacga

SEQ ID NO: 33112 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgctacga

SEQ ID NO: 33113 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgctacga

SEQ ID NO: 33114 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgctacga

SEQ ID NO: 33115 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgctacga

SEQ ID NO: 33116 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacga

SEQ ID NO: 33117 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacga

SEQ ID NO: 33118 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacga

SEQ ID NO: 33119 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacga

SEQ ID NO: 33120 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacga

SEQ ID NO: 33121 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacga

SEQ ID NO: 33122 - DNA, 167 bp, synthetic construct
  source 1..167: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacga

SEQ ID NO: 33123 - DNA, 168 bp, synthetic construct
  source 1..168: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacga

SEQ ID NO: 33124 - DNA, 169 bp, synthetic construct
  source 1..169: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacga

SEQ ID NO: 33125 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgccggcccttctcagttcgctacgac

SEQ ID NO: 33126 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgctcggcccttctcagttcgctacgac

SEQ ID NO: 33127 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcctcggcccttctcagttcgctacgac

SEQ ID NO: 33128 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgccctcggcccttctcagttcgctacgac

SEQ ID NO: 33129 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcacctcggcccttctcagttcgctacgac

SEQ ID NO: 33130 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgctacctcggcccttctcagttcgctacgac

SEQ ID NO: 33131 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgctacgac

SEQ ID NO: 33132 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgctacgac

SEQ ID NO: 33133 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgctacgac

SEQ ID NO: 33134 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgctacgac

SEQ ID NO: 33135 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgctacgac

SEQ ID NO: 33136 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgctacgac

SEQ ID NO: 33137 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgctacgac

SEQ ID NO: 33138 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgctacgac

SEQ ID NO: 33139 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgctacgac

SEQ ID NO: 33140 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgctacgac

SEQ ID NO: 33141 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgctacgac

SEQ ID NO: 33142 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgctacgac

SEQ ID NO: 33143 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgctacgac

SEQ ID NO: 33144 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgctacgac

SEQ ID NO: 33145 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgctacgac

SEQ ID NO: 33146 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgctacgac

SEQ ID NO: 33147 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgctacgac

SEQ ID NO: 33148 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgctacgac

SEQ ID NO: 33149 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgctacgac

SEQ ID NO: 33150 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgctacgac

SEQ ID NO: 33151 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgctacgac

SEQ ID NO: 33152 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgctacgac

SEQ ID NO: 33153 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgctacgac

SEQ ID NO: 33154 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgctacgac

SEQ ID NO: 33155 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgctacgac

SEQ ID NO: 33156 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgctacgac

SEQ ID NO: 33157 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgctacgac

SEQ ID NO: 33158 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgctacgac

SEQ ID NO: 33159 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgctacgac

SEQ ID NO: 33160 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgctacgac

SEQ ID NO: 33161 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgctacgac

SEQ ID NO: 33162 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgctacgac

SEQ ID NO: 33163 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgctacgac

SEQ ID NO: 33164 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgctacgac

SEQ ID NO: 33165 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgctacgac

SEQ ID NO: 33166 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgctacgac

SEQ ID NO: 33167 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgac

SEQ ID NO: 33168 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgac

SEQ ID NO: 33169 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgac

SEQ ID NO: 33170 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgac

SEQ ID NO: 33171 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgac

SEQ ID NO: 33172 - DNA, 167 bp, synthetic construct
  source 1..167: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgac

SEQ ID NO: 33173 - DNA, 168 bp, synthetic construct
  source 1..168: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgac

SEQ ID NO: 33174 - DNA, 169 bp, synthetic construct
  source 1..169: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgac

SEQ ID NO: 33175 - DNA, 170 bp, synthetic construct
  source 1..170: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgac

SEQ ID NO: 33176 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgccggcccttctcagttcgctacgacc

SEQ ID NO: 33177 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgctcggcccttctcagttcgctacgacc

SEQ ID NO: 33178 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcctcggcccttctcagttcgctacgacc

SEQ ID NO: 33179 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgccctcggcccttctcagttcgctacgacc

SEQ ID NO: 33180 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcacctcggcccttctcagttcgctacgacc

SEQ ID NO: 33181 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgctacctcggcccttctcagttcgctacgacc

SEQ ID NO: 33182 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgctacgacc

SEQ ID NO: 33183 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgctacgacc

SEQ ID NO: 33184 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgctacgacc

SEQ ID NO: 33185 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgctacgacc

SEQ ID NO: 33186 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgctacgacc

SEQ ID NO: 33187 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgctacgacc

SEQ ID NO: 33188 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgctacgacc

SEQ ID NO: 33189 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgctacgacc

SEQ ID NO: 33190 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgctacgacc

SEQ ID NO: 33191 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgctacgacc

SEQ ID NO: 33192 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgctacgacc

SEQ ID NO: 33193 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgctacgacc

SEQ ID NO: 33194 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgctacgacc

SEQ ID NO: 33195 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgctacgacc

SEQ ID NO: 33196 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgctacgacc

SEQ ID NO: 33197 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgctacgacc

SEQ ID NO: 33198 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgctacgacc

SEQ ID NO: 33199 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgctacgacc

SEQ ID NO: 33200 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgctacgacc

SEQ ID NO: 33201 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgctacgacc

SEQ ID NO: 33202 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgctacgacc

SEQ ID NO: 33203 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgctacgacc

SEQ ID NO: 33204 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgctacgacc

SEQ ID NO: 33205 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgctacgacc

SEQ ID NO: 33206 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgctacgacc

SEQ ID NO: 33207 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgctacgacc

SEQ ID NO: 33208 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgctacgacc

SEQ ID NO: 33209 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgctacgacc

SEQ ID NO: 33210 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgctacgacc

SEQ ID NO: 33211 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgctacgacc

SEQ ID NO: 33212 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgctacgacc

SEQ ID NO: 33213 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgctacgacc

SEQ ID NO: 33214 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgctacgacc

SEQ ID NO: 33215 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgctacgacc

SEQ ID NO: 33216 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacc

SEQ ID NO: 33217 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacc

SEQ ID NO: 33218 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacc

SEQ ID NO: 33219 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacc

SEQ ID NO: 33220 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacc

SEQ ID NO: 33221 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacc

SEQ ID NO: 33222 - DNA, 167 bp, synthetic construct
  source 1..167: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacc

SEQ ID NO: 33223 - DNA, 168 bp, synthetic construct
  source 1..168: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacc

SEQ ID NO: 33224 - DNA, 169 bp, synthetic construct
  source 1..169: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacc

SEQ ID NO: 33225 - DNA, 170 bp, synthetic construct
  source 1..170: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacc

SEQ ID NO: 33226 - DNA, 171 bp, synthetic construct
  source 1..171: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacc

SEQ ID NO: 33227 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgccggcccttctcagttcgctacgaccc

SEQ ID NO: 33228 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgctcggcccttctcagttcgctacgaccc

SEQ ID NO: 33229 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcctcggcccttctcagttcgctacgaccc

SEQ ID NO: 33230 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgccctcggcccttctcagttcgctacgaccc

SEQ ID NO: 33231 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcacctcggcccttctcagttcgctacgaccc

SEQ ID NO: 33232 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctacctcggcccttctcagttcgctacgaccc

SEQ ID NO: 33233 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgctacgaccc

SEQ ID NO: 33234 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgctacgaccc

SEQ ID NO: 33235 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgctacgaccc

SEQ ID NO: 33236 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgctacgaccc

SEQ ID NO: 33237 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgctacgaccc

SEQ ID NO: 33238 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgctacgaccc

SEQ ID NO: 33239 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgctacgaccc

SEQ ID NO: 33240 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgctacgaccc

SEQ ID NO: 33241 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgctacgaccc

SEQ ID NO: 33242 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgctacgaccc

SEQ ID NO: 33243 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgctacgaccc

SEQ ID NO: 33244 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgctacgaccc

SEQ ID NO: 33245 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgctacgaccc

SEQ ID NO: 33246 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgctacgaccc

SEQ ID NO: 33247 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgctacgaccc

SEQ ID NO: 33248 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgctacgaccc

SEQ ID NO: 33249 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgctacgaccc

SEQ ID NO: 33250 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgctacgaccc

SEQ ID NO: 33251 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgctacgaccc

SEQ ID NO: 33252 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgctacgaccc

SEQ ID NO: 33253 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgctacgaccc

SEQ ID NO: 33254 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgctacgaccc

SEQ ID NO: 33255 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgctacgaccc

SEQ ID NO: 33256 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgctacgaccc

SEQ ID NO: 33257 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgctacgaccc

SEQ ID NO: 33258 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgctacgaccc

SEQ ID NO: 33259 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgctacgaccc

SEQ ID NO: 33260 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgctacgaccc

SEQ ID NO: 33261 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgctacgaccc

SEQ ID NO: 33262 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgctacgaccc

SEQ ID NO: 33263 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgctacgaccc

SEQ ID NO: 33264 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgctacgaccc

SEQ ID NO: 33265 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgctacgaccc

SEQ ID NO: 33266 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgctacgaccc

SEQ ID NO: 33267 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgctacgaccc

SEQ ID NO: 33268 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgctacgaccc

SEQ ID NO: 33269 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgaccc

SEQ ID NO: 33270 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgaccc

SEQ ID NO: 33271 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgaccc

SEQ ID NO: 33272 - DNA, 167 bp, synthetic construct
  source 1..167: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgaccc

SEQ ID NO: 33273 - DNA, 168 bp, synthetic construct
  source 1..168: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgaccc

SEQ ID NO: 33274 - DNA, 169 bp, synthetic construct
  source 1..169: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgaccc

SEQ ID NO: 33275 - DNA, 170 bp, synthetic construct
  source 1..170: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgaccc

SEQ ID NO: 33276 - DNA, 171 bp, synthetic construct
  source 1..171: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgaccc

SEQ ID NO: 33277 - DNA, 172 bp, synthetic construct
  source 1..172: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgaccc

SEQ ID NO: 33278 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgccggcccttctcagttcgctacgaccca

SEQ ID NO: 33279 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgctcggcccttctcagttcgctacgaccca

SEQ ID NO: 33280 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcctcggcccttctcagttcgctacgaccca

SEQ ID NO: 33281 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgccctcggcccttctcagttcgctacgaccca

SEQ ID NO: 33282 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcacctcggcccttctcagttcgctacgaccca

SEQ ID NO: 33283 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctacctcggcccttctcagttcgctacgaccca

SEQ ID NO: 33284 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgctacgaccca

SEQ ID NO: 33285 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgctacgaccca

SEQ ID NO: 33286 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgctacgaccca

SEQ ID NO: 33287 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgctacgaccca

SEQ ID NO: 33288 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgctacgaccca

SEQ ID NO: 33289 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgctacgaccca

SEQ ID NO: 33290 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgctacgaccca

SEQ ID NO: 33291 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgctacgaccca

SEQ ID NO: 33292 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgctacgaccca

SEQ ID NO: 33293 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgctacgaccca

SEQ ID NO: 33294 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgctacgaccca

SEQ ID NO: 33295 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgctacgaccca

SEQ ID NO: 33296 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgctacgaccca

SEQ ID NO: 33297 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgctacgaccca

SEQ ID NO: 33298 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgctacgaccca

SEQ ID NO: 33299 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgctacgaccca

SEQ ID NO: 33300 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgctacgaccca

SEQ ID NO: 33301 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgctacgaccca

SEQ ID NO: 33302 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgctacgaccca

SEQ ID NO: 33303 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgctacgaccca

SEQ ID NO: 33304 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgctacgaccca

SEQ ID NO: 33305 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgctacgaccca

SEQ ID NO: 33306 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgctacgaccca

SEQ ID NO: 33307 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgctacgaccca

SEQ ID NO: 33308 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgctacgaccca

SEQ ID NO: 33309 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgctacgaccca

SEQ ID NO: 33310 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgctacgaccca

SEQ ID NO: 33311 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgctacgaccca

SEQ ID NO: 33312 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgctacgaccca

SEQ ID NO: 33313 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgctacgaccca

SEQ ID NO: 33314 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgctacgaccca

SEQ ID NO: 33315 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgctacgaccca

SEQ ID NO: 33316 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgctacgaccca

SEQ ID NO: 33317 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgctacgaccca

SEQ ID NO: 33318 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgctacgaccca

SEQ ID NO: 33319 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgctacgaccca

SEQ ID NO: 33320 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgaccca

SEQ ID NO: 33321 - DNA, 166 bp, synthetic construct
  source 1..166: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgaccca

SEQ ID NO: 33322 - DNA, 167 bp, synthetic construct
  source 1..167: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgaccca

SEQ ID NO: 33323 - DNA, 168 bp, synthetic construct
  source 1..168: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgaccca

SEQ ID NO: 33324 - DNA, 169 bp, synthetic construct
  source 1..169: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgaccca

SEQ ID NO: 33325 - DNA, 170 bp, synthetic construct
  source 1..170: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgaccca

SEQ ID NO: 33326 - DNA, 171 bp, synthetic construct
  source 1..171: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgaccca

SEQ ID NO: 33327 - DNA, 172 bp, synthetic construct
  source 1..172: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgaccca

SEQ ID NO: 33328 - DNA, 173 bp, synthetic construct
  source 1..173: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgaccca

SEQ ID NO: 33329 - DNA, 107 bp, synthetic construct
  source 1..107: mol_type = other DNA
tgggtcgtagcgaactgagagttttagagctagaaatagcaagttaaaataaggctagtccgttatcaacttgaaaaagtggcaccgagtcggtgccggcccttctc

SEQ ID NO: 33330 - DNA, 108 bp, synthetic construct
  source 1..108: mol_type = other DNA
tgggtcgtagcgaactgagagttttagagctagaaatagcaagttaaaataaggctagtccgttatcaacttgaaaaagtggcaccgagtcggtgctcggcccttctc

SEQ ID NO: 33331 - DNA, 109 bp, synthetic construct
  source 1..109: mol_type = other DNA
tgggtcgtagcgaactgagagttttagagctagaaatagcaagttaaaataaggctagtccgttatcaacttgaaaaagtggcaccgagtcggtgcctcggcccttctc

SEQ ID NO: 33332 - DNA, 110 bp, synthetic construct
  source 1..110: mol_type = other DNA
tgggtcgtagcgaactgagagttttagagctagaaatagcaagttaaaataaggctagtccgttatcaacttgaaaaagtggcaccgagtcggtgccctcggcccttctc

SEQ ID NO: 33333 - DNA, 111 bp, synthetic construct
  source 1..111: mol_type = other DNA
tgggtcgtagcgaactgagagttttagagctagaaatagcaagttaaaataaggctagtccgttatcaacttgaaaaagtggcaccgagtcggtgcacctcggcccttctc

SEQ ID NO: 33334 - DNA, 112 bp, synthetic construct
  source 1..112: mol_type = other DNA
tgggtcgtagcgaactgagagttttagagctagaaatagcaagttaaaataaggctagtccgttatcaacttgaaaaagtggcaccgagtcggtgctacctcggcccttctc

SEQ ID NO: 33335 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgcatacctcggcccttctc

SEQ ID NO: 33336 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgcaatacctcggcccttctc

SEQ ID NO: 33337 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgccaatacctcggcccttctc

SEQ ID NO: 33338 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgcacaatacctcggcccttctc

SEQ ID NO: 33339 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgccacaatacctcggcccttctc

SEQ ID NO: 33340 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgcccacaatacctcggcccttctc

SEQ ID NO: 33341 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgcgccacaatacctcggcccttctc

SEQ ID NO: 33342 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgctgccacaatacctcggcccttctc

SEQ ID NO: 33343 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctc

SEQ ID NO: 33344 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctc

SEQ ID NO: 33345 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctc

SEQ ID NO: 33346 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctc

SEQ ID NO: 33347 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctc

SEQ ID NO: 33348 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctc

SEQ ID NO: 33349 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctc

SEQ ID NO: 33350 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctc

SEQ ID NO: 33351 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctc

SEQ ID NO: 33352 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctc

SEQ ID NO: 33353 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctc

SEQ ID NO: 33354 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctc

SEQ ID NO: 33355 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctc

SEQ ID NO: 33356 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctc

SEQ ID NO: 33357 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctc

SEQ ID NO: 33358 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctc

SEQ ID NO: 33359 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctc

SEQ ID NO: 33360 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctc

SEQ ID NO: 33361 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctc

SEQ ID NO: 33362 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctc

SEQ ID NO: 33363 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctc

SEQ ID NO: 33364 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctc

SEQ ID NO: 33365 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctc

SEQ ID NO: 33366 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctc

SEQ ID NO: 33367 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctc

SEQ ID NO: 33368 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctc

SEQ ID NO: 33369 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctc

SEQ ID NO: 33370 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctc

SEQ ID NO: 33371 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctc

SEQ ID NO: 33372 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctc

SEQ ID NO: 33373 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctc

SEQ ID NO: 33374 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctc

SEQ ID NO: 33375 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctc

SEQ ID NO: 33376 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctc

SEQ ID NO: 33377 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctc

SEQ ID NO: 33378 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctc

SEQ ID NO: 33379 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctc

SEQ ID NO: 33380 - DNA, 108 bp, synthetic construct
  source 1..108: mol_type = other DNA
tgggtcgtagcgaactgagagttttagagctagaaatagcaagttaaaataaggctagtccgttatcaacttgaaaaagtggcaccgagtcggtgccggcccttctca

SEQ ID NO: 33381 - DNA, 109 bp, synthetic construct
  source 1..109: mol_type = other DNA
tgggtcgtagcgaactgagagttttagagctagaaatagcaagttaaaataaggctagtccgttatcaacttgaaaaagtggcaccgagtcggtgctcggcccttctca

SEQ ID NO: 33382 - DNA, 110 bp, synthetic construct
  source 1..110: mol_type = other DNA
tgggtcgtagcgaactgagagttttagagctagaaatagcaagttaaaataaggctagtccgttatcaacttgaaaaagtggcaccgagtcggtgcctcggcccttctca

SEQ ID NO: 33383 - DNA, 111 bp, synthetic construct
  source 1..111: mol_type = other DNA
tgggtcgtagcgaactgagagttttagagctagaaatagcaagttaaaataaggctagtccgttatcaacttgaaaaagtggcaccgagtcggtgccctcggcccttctca

SEQ ID NO: 33384 - DNA, 112 bp, synthetic construct
  source 1..112: mol_type = other DNA
tgggtcgtagcgaactgagagttttagagctagaaatagcaagttaaaataaggctagtccgttatcaacttgaaaaagtggcaccgagtcggtgcacctcggcccttctca

SEQ ID NO: 33385 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgctacctcggcccttctca

SEQ ID NO: 33386 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgcatacctcggcccttctca

SEQ ID NO: 33387 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgcaatacctcggcccttctca

SEQ ID NO: 33388 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgccaatacctcggcccttctca

SEQ ID NO: 33389 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgcacaatacctcggcccttctca

SEQ ID NO: 33390 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgccacaatacctcggcccttctca

SEQ ID NO: 33391 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgcccacaatacctcggcccttctca

SEQ ID NO: 33392 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcgccacaatacctcggcccttctca

SEQ ID NO: 33393 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgctgccacaatacctcggcccttctca

SEQ ID NO: 33394 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctca

SEQ ID NO: 33395 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctca

SEQ ID NO: 33396 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctca

SEQ ID NO: 33397 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctca

SEQ ID NO: 33398 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctca

SEQ ID NO: 33399 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctca

SEQ ID NO: 33400 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctca

SEQ ID NO: 33401 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctca

SEQ ID NO: 33402 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctca

SEQ ID NO: 33403 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctca

SEQ ID NO: 33404 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctca

SEQ ID NO: 33405 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctca

SEQ ID NO: 33406 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctca

SEQ ID NO: 33407 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctca

SEQ ID NO: 33408 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctca

SEQ ID NO: 33409 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctca

SEQ ID NO: 33410 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctca

SEQ ID NO: 33411 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctca

SEQ ID NO: 33412 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctca

SEQ ID NO: 33413 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctca

SEQ ID NO: 33414 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctca

SEQ ID NO: 33415 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctca

SEQ ID NO: 33416 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctca

SEQ ID NO: 33417 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctca

SEQ ID NO: 33418 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctca

SEQ ID NO: 33419 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctca

SEQ ID NO: 33420 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctca

SEQ ID NO: 33421 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctca

SEQ ID NO: 33422 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctca

SEQ ID NO: 33423 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctca

SEQ ID NO: 33424 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctca

SEQ ID NO: 33425 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctca

SEQ ID NO: 33426 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctca

SEQ ID NO: 33427 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctca

SEQ ID NO: 33428 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctca

SEQ ID NO: 33429 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctca

SEQ ID NO: 33430 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctca

SEQ ID NO: 33431 - DNA, 109 bp, synthetic construct
  source 1..109: mol_type = other DNA
tgggtcgtagcgaactgagagttttagagctagaaatagcaagttaaaataaggctagtccgttatcaacttgaaaaagtggcaccgagtcggtgccggcccttctcag

SEQ ID NO: 33432 - DNA, 110 bp, synthetic construct
  source 1..110: mol_type = other DNA
tgggtcgtagcgaactgagagttttagagctagaaatagcaagttaaaataaggctagtccgttatcaacttgaaaaagtggcaccgagtcggtgctcggcccttctcag

SEQ ID NO: 33433 - DNA, 111 bp, synthetic construct
  source 1..111: mol_type = other DNA
tgggtcgtagcgaactgagagttttagagctagaaatagcaagttaaaataaggctagtccgttatcaacttgaaaaagtggcaccgagtcggtgcctcggcccttctcag

SEQ ID NO: 33434 - DNA, 112 bp, synthetic construct
  source 1..112: mol_type = other DNA
tgggtcgtagcgaactgagagttttagagctagaaatagcaagttaaaataaggctagtccgttatcaacttgaaaaagtggcaccgagtcggtgccctcggcccttctcag

SEQ ID NO: 33435 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgcacctcggcccttctcag

SEQ ID NO: 33436 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgctacctcggcccttctcag

SEQ ID NO: 33437 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgcatacctcggcccttctcag

SEQ ID NO: 33438 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgcaatacctcggcccttctcag

SEQ ID NO: 33439 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgccaatacctcggcccttctcag

SEQ ID NO: 33440 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgcacaatacctcggcccttctcag

SEQ ID NO: 33441 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgccacaatacctcggcccttctcag

SEQ ID NO: 33442 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcccacaatacctcggcccttctcag

SEQ ID NO: 33443 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcag

SEQ ID NO: 33444 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcag

SEQ ID NO: 33445 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcag

SEQ ID NO: 33446 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcag

SEQ ID NO: 33447 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcag

SEQ ID NO: 33448 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcag

SEQ ID NO: 33449 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcag

SEQ ID NO: 33450 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcag

SEQ ID NO: 33451 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcag

SEQ ID NO: 33452 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcag

SEQ ID NO: 33453 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcag

SEQ ID NO: 33454 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcag

SEQ ID NO: 33455 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcag

SEQ ID NO: 33456 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcag

SEQ ID NO: 33457 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcag

SEQ ID NO: 33458 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcag

SEQ ID NO: 33459 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcag

SEQ ID NO: 33460 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcag

SEQ ID NO: 33461 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcag

SEQ ID NO: 33462 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcag

SEQ ID NO: 33463 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcag

SEQ ID NO: 33464 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcag

SEQ ID NO: 33465 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcag

SEQ ID NO: 33466 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcag

SEQ ID NO: 33467 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcag

SEQ ID NO: 33468 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcag

SEQ ID NO: 33469 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcag

SEQ ID NO: 33470 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcag

SEQ ID NO: 33471 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcag

SEQ ID NO: 33472 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcag

SEQ ID NO: 33473 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcag

SEQ ID NO: 33474 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcag

SEQ ID NO: 33475 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcag

SEQ ID NO: 33476 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcag

SEQ ID NO: 33477 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcag

SEQ ID NO: 33478 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcag

SEQ ID NO: 33479 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcag

SEQ ID NO: 33480 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcag

SEQ ID NO: 33481 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcag

SEQ ID NO: 33482 - DNA, 110 bp, synthetic construct
  source 1..110: mol_type = other DNA
tgggtcgtagcgaactgagagttttagagctagaaatagcaagttaaaataaggctagtccgttatcaacttgaaaaagtggcaccgagtcggtgccggcccttctcagt

SEQ ID NO: 33483 - DNA, 111 bp, synthetic construct
  source 1..111: mol_type = other DNA
tgggtcgtagcgaactgagagttttagagctagaaatagcaagttaaaataaggctagtccgttatcaacttgaaaaagtggcaccgagtcggtgctcggcccttctcagt

SEQ ID NO: 33484 - DNA, 112 bp, synthetic construct
  source 1..112: mol_type = other DNA
tgggtcgtagcgaactgagagttttagagctagaaatagcaagttaaaataaggctagtccgttatcaacttgaaaaagtggcaccgagtcggtgcctcggcccttctcagt

SEQ ID NO: 33485 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgccctcggcccttctcagt

SEQ ID NO: 33486 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgcacctcggcccttctcagt

SEQ ID NO: 33487 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgctacctcggcccttctcagt

SEQ ID NO: 33488 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgcatacctcggcccttctcagt

SEQ ID NO: 33489 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgcaatacctcggcccttctcagt

SEQ ID NO: 33490 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgccaatacctcggcccttctcagt

SEQ ID NO: 33491 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgcacaatacctcggcccttctcagt

SEQ ID NO: 33492 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgccacaatacctcggcccttctcagt

SEQ ID NO: 33493 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagt

SEQ ID NO: 33494 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagt

SEQ ID NO: 33495 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagt

SEQ ID NO: 33496 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagt

SEQ ID NO: 33497 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagt

SEQ ID NO: 33498 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagt

SEQ ID NO: 33499 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagt

SEQ ID NO: 33500 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagt

SEQ ID NO: 33501 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagt

SEQ ID NO: 33502 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagt

SEQ ID NO: 33503 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagt

SEQ ID NO: 33504 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagt

SEQ ID NO: 33505 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagt

SEQ ID NO: 33506 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagt

SEQ ID NO: 33507 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagt

SEQ ID NO: 33508 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagt

SEQ ID NO: 33509 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagt

SEQ ID NO: 33510 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagt

SEQ ID NO: 33511 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagt

SEQ ID NO: 33512 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagt

SEQ ID NO: 33513 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagt

SEQ ID NO: 33514 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagt

SEQ ID NO: 33515 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagt

SEQ ID NO: 33516 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagt

SEQ ID NO: 33517 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagt

SEQ ID NO: 33518 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagt

SEQ ID NO: 33519 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagt

SEQ ID NO: 33520 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagt

SEQ ID NO: 33521 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagt

SEQ ID NO: 33522 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagt

SEQ ID NO: 33523 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagt

SEQ ID NO: 33524 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagt

SEQ ID NO: 33525 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagt

SEQ ID NO: 33526 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagt

SEQ ID NO: 33527 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagt

SEQ ID NO: 33528 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagt

SEQ ID NO: 33529 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagt

SEQ ID NO: 33530 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagt

SEQ ID NO: 33531 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagt

SEQ ID NO: 33532 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagt

SEQ ID NO: 33533 - DNA, 111 bp, synthetic construct
  source 1..111: mol_type = other DNA
tgggtcgtagcgaactgagagttttagagctagaaatagcaagttaaaataaggctagtccgttatcaacttgaaaaagtggcaccgagtcggtgccggcccttctcagtt

SEQ ID NO: 33534 - DNA, 112 bp, synthetic construct
  source 1..112: mol_type = other DNA
tgggtcgtagcgaactgagagttttagagctagaaatagcaagttaaaataaggctagtccgttatcaacttgaaaaagtggcaccgagtcggtgctcggcccttctcagtt

SEQ ID NO: 33535 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgcctcggcccttctcagtt

SEQ ID NO: 33536 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgccctcggcccttctcagtt

SEQ ID NO: 33537 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgcacctcggcccttctcagtt

SEQ ID NO: 33538 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgctacctcggcccttctcagtt

SEQ ID NO: 33539 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgcatacctcggcccttctcagtt

SEQ ID NO: 33540 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgcaatacctcggcccttctcagtt

SEQ ID NO: 33541 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgccaatacctcggcccttctcagtt

SEQ ID NO: 33542 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcacaatacctcggcccttctcagtt

SEQ ID NO: 33543 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgccacaatacctcggcccttctcagtt

SEQ ID NO: 33544 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagtt

SEQ ID NO: 33545 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagtt

SEQ ID NO: 33546 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagtt

SEQ ID NO: 33547 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagtt

SEQ ID NO: 33548 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagtt

SEQ ID NO: 33549 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagtt

SEQ ID NO: 33550 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagtt

SEQ ID NO: 33551 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagtt

SEQ ID NO: 33552 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagtt

SEQ ID NO: 33553 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagtt

SEQ ID NO: 33554 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagtt

SEQ ID NO: 33555 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagtt

SEQ ID NO: 33556 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagtt

SEQ ID NO: 33557 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagtt

SEQ ID NO: 33558 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagtt

SEQ ID NO: 33559 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagtt

SEQ ID NO: 33560 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagtt

SEQ ID NO: 33561 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagtt

SEQ ID NO: 33562 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagtt

SEQ ID NO: 33563 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagtt

SEQ ID NO: 33564 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagtt

SEQ ID NO: 33565 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagtt

SEQ ID NO: 33566 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagtt

SEQ ID NO: 33567 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagtt

SEQ ID NO: 33568 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagtt

SEQ ID NO: 33569 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagtt

SEQ ID NO: 33570 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagtt

SEQ ID NO: 33571 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagtt

SEQ ID NO: 33572 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagtt

SEQ ID NO: 33573 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagtt

SEQ ID NO: 33574 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagtt

SEQ ID NO: 33575 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagtt

SEQ ID NO: 33576 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagtt

SEQ ID NO: 33577 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagtt

SEQ ID NO: 33578 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagtt

SEQ ID NO: 33579 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagtt

SEQ ID NO: 33580 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagtt

SEQ ID NO: 33581 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagtt

SEQ ID NO: 33582 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagtt

SEQ ID NO: 33583 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagtt

SEQ ID NO: 33584 - DNA, 112 bp, synthetic construct
  source 1..112: mol_type = other DNA
tgggtcgtagcgaactgagagttttagagctagaaatagcaagttaaaataaggctagtccgttatcaacttgaaaaagtggcaccgagtcggtgccggcccttctcagttc

SEQ ID NO: 33585 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgctcggcccttctcagttc

SEQ ID NO: 33586 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgcctcggcccttctcagttc

SEQ ID NO: 33587 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgccctcggcccttctcagttc

SEQ ID NO: 33588 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgcacctcggcccttctcagttc

SEQ ID NO: 33589 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgctacctcggcccttctcagttc

SEQ ID NO: 33590 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgcatacctcggcccttctcagttc

SEQ ID NO: 33591 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgcaatacctcggcccttctcagttc

SEQ ID NO: 33592 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgccaatacctcggcccttctcagttc

SEQ ID NO: 33593 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttc

SEQ ID NO: 33594 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttc

SEQ ID NO: 33595 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttc

SEQ ID NO: 33596 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttc

SEQ ID NO: 33597 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttc

SEQ ID NO: 33598 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttc

SEQ ID NO: 33599 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttc

SEQ ID NO: 33600 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttc

SEQ ID NO: 33601 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttc

SEQ ID NO: 33602 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttc

SEQ ID NO: 33603 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttc

SEQ ID NO: 33604 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttc

SEQ ID NO: 33605 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttc

SEQ ID NO: 33606 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttc

SEQ ID NO: 33607 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttc

SEQ ID NO: 33608 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttc

SEQ ID NO: 33609 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttc

SEQ ID NO: 33610 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttc

SEQ ID NO: 33611 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttc

SEQ ID NO: 33612 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttc

SEQ ID NO: 33613 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttc

SEQ ID NO: 33614 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttc

SEQ ID NO: 33615 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttc

SEQ ID NO: 33616 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttc

SEQ ID NO: 33617 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttc

SEQ ID NO: 33618 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttc

SEQ ID NO: 33619 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttc

SEQ ID NO: 33620 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttc

SEQ ID NO: 33621 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttc

SEQ ID NO: 33622 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttc

SEQ ID NO: 33623 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttc

SEQ ID NO: 33624 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttc

SEQ ID NO: 33625 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttc

SEQ ID NO: 33626 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttc

SEQ ID NO: 33627 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttc

SEQ ID NO: 33628 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttc

SEQ ID NO: 33629 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttc

SEQ ID NO: 33630 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttc

SEQ ID NO: 33631 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttc

SEQ ID NO: 33632 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttc

SEQ ID NO: 33633 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttc

SEQ ID NO: 33634 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttc

SEQ ID NO: 33635 - DNA, 113 bp, synthetic construct
  source 1..113: mol_type = other DNA
tgggtcgtagcgaactgagagttttagagctagaaatagcaagttaaaataaggctagtccgttatcaacttgaaaaagtggcaccgagtcggtgccggcccttctcagttcg

SEQ ID NO: 33636 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgctcggcccttctcagttcg

SEQ ID NO: 33637 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgcctcggcccttctcagttcg

SEQ ID NO: 33638 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgccctcggcccttctcagttcg

SEQ ID NO: 33639 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgcacctcggcccttctcagttcg

SEQ ID NO: 33640 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgctacctcggcccttctcagttcg

SEQ ID NO: 33641 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgcatacctcggcccttctcagttcg

SEQ ID NO: 33642 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcg

SEQ ID NO: 33643 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcg

SEQ ID NO: 33644 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcg

SEQ ID NO: 33645 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcg

SEQ ID NO: 33646 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcg

SEQ ID NO: 33647 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcg

SEQ ID NO: 33648 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcg

SEQ ID NO: 33649 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcg

SEQ ID NO: 33650 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcg

SEQ ID NO: 33651 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcg

SEQ ID NO: 33652 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcg

SEQ ID NO: 33653 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcg

SEQ ID NO: 33654 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcg

SEQ ID NO: 33655 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcg

SEQ ID NO: 33656 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcg

SEQ ID NO: 33657 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcg

SEQ ID NO: 33658 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcg

SEQ ID NO: 33659 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcg

SEQ ID NO: 33660 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcg

SEQ ID NO: 33661 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcg

SEQ ID NO: 33662 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcg

SEQ ID NO: 33663 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcg

SEQ ID NO: 33664 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcg

SEQ ID NO: 33665 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcg

SEQ ID NO: 33666 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcg

SEQ ID NO: 33667 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcg

SEQ ID NO: 33668 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcg

SEQ ID NO: 33669 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcg

SEQ ID NO: 33670 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcg

SEQ ID NO: 33671 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcg

SEQ ID NO: 33672 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcg

SEQ ID NO: 33673 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcg

SEQ ID NO: 33674 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcg

SEQ ID NO: 33675 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcg

SEQ ID NO: 33676 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcg

SEQ ID NO: 33677 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcg

SEQ ID NO: 33678 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcg

SEQ ID NO: 33679 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcg

SEQ ID NO: 33680 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcg

SEQ ID NO: 33681 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcg

SEQ ID NO: 33682 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcg

SEQ ID NO: 33683 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcg

SEQ ID NO: 33684 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcg

SEQ ID NO: 33685 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcg

SEQ ID NO: 33686 - DNA, 114 bp, synthetic construct
  source 1..114: mol_type = other DNA
tgggtcgtagcgaactgagagttttagagctagaaatagcaagttaaaataaggctagtccgttatcaacttgaaaaagtggcaccgagtcggtgccggcccttctcagttcgc

SEQ ID NO: 33687 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgctcggcccttctcagttcgc

SEQ ID NO: 33688 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgcctcggcccttctcagttcgc

SEQ ID NO: 33689 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgccctcggcccttctcagttcgc

SEQ ID NO: 33690 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgcacctcggcccttctcagttcgc

SEQ ID NO: 33691 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgctacctcggcccttctcagttcgc

SEQ ID NO: 33692 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgc

SEQ ID NO: 33693 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgc

SEQ ID NO: 33694 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgc

SEQ ID NO: 33695 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgc

SEQ ID NO: 33696 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgc

SEQ ID NO: 33697 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgc

SEQ ID NO: 33698 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgc

SEQ ID NO: 33699 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgc

SEQ ID NO: 33700 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgc

SEQ ID NO: 33701 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgc

SEQ ID NO: 33702 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgc

SEQ ID NO: 33703 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgc

SEQ ID NO: 33704 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgc

SEQ ID NO: 33705 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgc

SEQ ID NO: 33706 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgc

SEQ ID NO: 33707 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgc

SEQ ID NO: 33708 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgc

SEQ ID NO: 33709 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgc

SEQ ID NO: 33710 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgc

SEQ ID NO: 33711 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgc

SEQ ID NO: 33712 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgc

SEQ ID NO: 33713 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgc

SEQ ID NO: 33714 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgc

SEQ ID NO: 33715 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgc

SEQ ID NO: 33716 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgc

SEQ ID NO: 33717 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgc

SEQ ID NO: 33718 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgc

SEQ ID NO: 33719 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgc

SEQ ID NO: 33720 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgc

SEQ ID NO: 33721 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgc

SEQ ID NO: 33722 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgc

SEQ ID NO: 33723 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgc

SEQ ID NO: 33724 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgc

SEQ ID NO: 33725 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgc

SEQ ID NO: 33726 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgc

SEQ ID NO: 33727 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgc

SEQ ID NO: 33728 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgc

SEQ ID NO: 33729 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgc

SEQ ID NO: 33730 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgc

SEQ ID NO: 33731 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgc

SEQ ID NO: 33732 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgc

SEQ ID NO: 33733 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgc

SEQ ID NO: 33734 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgc

SEQ ID NO: 33735 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgc

SEQ ID NO: 33736 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgc

SEQ ID NO: 33737 - DNA, 115 bp, synthetic construct
  source 1..115: mol_type = other DNA
tgggtcgtagcgaactgagagttttagagctagaaatagcaagttaaaataaggctagtccgttatcaacttgaaaaagtggcaccgagtcggtgccggcccttctcagttcgct

SEQ ID NO: 33738 - DNA, 116 bp, synthetic construct
  source 1..116: mol_type = other DNA
tgggtcgtagcgaactgagagttttagagctagaaatagcaagttaaaataaggctagtccgttatcaacttgaaaaagtggcaccgagtcggtgctcggcccttctcagttcgct

SEQ ID NO: 33739 - DNA, 117 bp, synthetic construct
  source 1..117: mol_type = other DNA
tgggtcgtagcgaactgagagttttagagctagaaatagcaagttaaaataaggctagtccgttatcaacttgaaaaagtggcaccgagtcggtgcctcggcccttctcagttcgct

SEQ ID NO: 33740 - DNA, 118 bp, synthetic construct
  source 1..118: mol_type = other DNA
tgggtcgtagcgaactgagagttttagagctagaaatagcaagttaaaataaggctagtccgttatcaacttgaaaaagtggcaccgagtcggtgccctcggcccttctcagttcgct

SEQ ID NO: 33741 - DNA, 119 bp, synthetic construct
  source 1..119: mol_type = other DNA
tgggtcgtagcgaactgagagttttagagctagaaatagcaagttaaaataaggctagtccgttatcaacttgaaaaagtggcaccgagtcggtgcacctcggcccttctcagttcgct

SEQ ID NO: 33742 - DNA, 120 bp, synthetic construct
  source 1..120: mol_type = other DNA
tgggtcgtagcgaactgagagttttagagctagaaatagcaagttaaaataaggctagtccgttatcaacttgaaaaagtggcaccgagtcggtgctacctcggcccttctcagttcgct

SEQ ID NO: 33743 - DNA, 121 bp, synthetic construct
  source 1..121: mol_type = other DNA
tgggtcgtagcgaactgagagttttagagctagaaatagcaagttaaaataaggctagtccgttatcaacttgaaaaagtggcaccgagtcggtgcatacctcggcccttctcagttcgct

SEQ ID NO: 33744 - DNA, 122 bp, synthetic construct
  source 1..122: mol_type = other DNA
tgggtcgtagcgaactgagagttttagagctagaaatagcaagttaaaataaggctagtccgttatcaacttgaaaaagtggcaccgagtcggtgcaatacctcggcccttctcagttcgct

SEQ ID NO: 33745 - DNA, 123 bp, synthetic construct
  source 1..123: mol_type = other DNA
tgggtcgtagcgaactgagagttttagagctagaaatagcaagttaaaataaggctagtccgttatcaacttgaaaaagtggcaccgagtcggtgccaatacctcggcccttctcagttcgct

SEQ ID NO: 33746 - DNA, 124 bp, synthetic construct
  source 1..124: mol_type = other DNA
tgggtcgtagcgaactgagagttttagagctagaaatagcaagttaaaataaggctagtccgttatcaacttgaaaaagtggcaccgagtcggtgcacaatacctcggcccttctcagttcgct

SEQ ID NO: 33747 - DNA, 125 bp, synthetic construct
  source 1..125: mol_type = other DNA
tgggtcgtagcgaactgagagttttagagctagaaatagcaagttaaaataaggctagtccgttatcaacttgaaaaagtggcaccgagtcggtgccacaatacctcggcccttctcagttcgct

SEQ ID NO: 33748 - DNA, 126 bp, synthetic construct
  source 1..126: mol_type = other DNA
tgggtcgtagcgaactgagagttttagagctagaaatagcaagttaaaataaggctagtccgttatcaacttgaaaaagtggcaccgagtcggtgcccacaatacctcggcccttctcagttcgct

SEQ ID NO: 33749 - DNA, 127 bp, synthetic construct
  source 1..127: mol_type = other DNA
tgggtcgtagcgaactgagagttttagagctagaaatagcaagttaaaataaggctagtccgttatcaacttgaaaaagtggcaccgagtcggtgcgccacaatacctcggcccttctcagttcgct

SEQ ID NO: 33750 - DNA, 128 bp, synthetic construct
  source 1..128: mol_type = other DNA
tgggtcgtagcgaactgagagttttagagctagaaatagcaagttaaaataaggctagtccgttatcaacttgaaaaagtggcaccgagtcggtgctgccacaatacctcggcccttctcagttcgct

SEQ ID NO: 33751 - DNA, 129 bp, synthetic construct
  source 1..129: mol_type = other DNA
tgggtcgtagcgaactgagagttttagagctagaaatagcaagttaaaataaggctagtccgttatcaacttgaaaaagtggcaccgagtcggtgcctgccacaatacctcggcccttctcagttcgct

SEQ ID NO: 33752 - DNA, 130 bp, synthetic construct
  source 1..130: mol_type = other DNA
tgggtcgtagcgaactgagagttttagagctagaaatagcaagttaaaataaggctagtccgttatcaacttgaaaaagtggcaccgagtcggtgcgctgccacaatacctcggcccttctcagttcgct

SEQ ID NO: 33753 - DNA, 131 bp, synthetic construct
  source 1..131: mol_type = other DNA
tgggtcgtagcgaactgagagttttagagctagaaatagcaagttaaaataaggctagtccgttatcaacttgaaaaagtggcaccgagtcggtgctgctgccacaatacctcggcccttctcagttcgct

SEQ ID NO: 33754 - DNA, 132 bp, synthetic construct
  source 1..132: mol_type = other DNA
tgggtcgtagcgaactgagagttttagagctagaaatagcaagttaaaataaggctagtccgttatcaacttgaaaaagtggcaccgagtcggtgcttgctgccacaatacctcggcccttctcagttcgct

SEQ ID NO: 33755 - DNA, 133 bp, synthetic construct
  source 1..133: mol_type = other DNA
tgggtcgtagcgaactgagagttttagagctagaaatagcaagttaaaataaggctagtccgttatcaacttgaaaaagtggcaccgagtcggtgctttgctgccacaatacctcggcccttctcagttcgct

SEQ ID NO: 33756 - DNA, 134 bp, synthetic construct
  source 1..134: mol_type = other DNA
tgggtcgtagcgaactgagagttttagagctagaaatagcaagttaaaataaggctagtccgttatcaacttgaaaaagtggcaccgagtcggtgcctttgctgccacaatacctcggcccttctcagttcgct

SEQ ID NO: 33757 - DNA, 135 bp, synthetic construct
  source 1..135: mol_type = other DNA
tgggtcgtagcgaactgagagttttagagctagaaatagcaagttaaaataaggctagtccgttatcaacttgaaaaagtggcaccgagtcggtgcactttgctgccacaatacctcggcccttctcagttcgct

SEQ ID NO: 33758 - DNA, 136 bp, synthetic construct
  source 1..136: mol_type = other DNA
tgggtcgtagcgaactgagagttttagagctagaaatagcaagttaaaataaggctagtccgttatcaacttgaaaaagtggcaccgagtcggtgcaactttgctgccacaatacctcggcccttctcagttcgct

SEQ ID NO: 33759 - DNA, 137 bp, synthetic construct
  source 1..137: mol_type = other DNA
tgggtcgtagcgaactgagagttttagagctagaaatagcaagttaaaataaggctagtccgttatcaacttgaaaaagtggcaccgagtcggtgcgaactttgctgccacaatacctcggcccttctcagttcgct

SEQ ID NO: 33760 - DNA, 138 bp, synthetic construct
  source 1..138: mol_type = other DNA
tgggtcgtagcgaactgagagttttagagctagaaatagcaagttaaaataaggctagtccgttatcaacttgaaaaagtggcaccgagtcggtgcggaactttgctgccacaatacctcggcccttctcagttcgct

SEQ ID NO: 33761 - DNA, 139 bp, synthetic construct
  source 1..139: mol_type = other DNA
tgggtcgtagcgaactgagagttttagagctagaaatagcaagttaaaataaggctagtccgttatcaacttgaaaaagtggcaccgagtcggtgcaggaactttgctgccacaatacctcggcccttctcagttcgct

SEQ ID NO: 33762 - DNA, 140 bp, synthetic construct
  source 1..140: mol_type = other DNA
tgggtcgtagcgaactgagagttttagagctagaaatagcaagttaaaataaggctagtccgttatcaacttgaaaaagtggcaccgagtcggtgctaggaactttgctgccacaatacctcggcccttctcagttcgct

SEQ ID NO: 33763 - DNA, 141 bp, synthetic construct
  source 1..141: mol_type = other DNA
tgggtcgtagcgaactgagagttttagagctagaaatagcaagttaaaataaggctagtccgttatcaacttgaaaaagtggcaccgagtcggtgcttaggaactttgctgccacaatacctcggcccttctcagttcgct

SEQ ID NO: 33764 - DNA, 142 bp, synthetic construct
  source 1..142: mol_type = other DNA
tgggtcgtagcgaactgagagttttagagctagaaatagcaagttaaaataaggctagtccgttatcaacttgaaaaagtggcaccgagtcggtgccttaggaactttgctgccacaatacctcggcccttctcagttcgct

SEQ ID NO: 33765 - DNA, 143 bp, synthetic construct
  source 1..143: mol_type = other DNA
tgggtcgtagcgaactgagagttttagagctagaaatagcaagttaaaataaggctagtccgttatcaacttgaaaaagtggcaccgagtcggtgctcttaggaactttgctgccacaatacctcggcccttctcagttcgct

SEQ ID NO: 33766 - DNA, 144 bp, synthetic construct
  source 1..144: mol_type = other DNA
tgggtcgtagcgaactgagagttttagagctagaaatagcaagttaaaataaggctagtccgttatcaacttgaaaaagtggcaccgagtcggtgcgtcttaggaactttgctgccacaatacctcggcccttctcagttcgct

SEQ ID NO: 33767 - DNA, 145 bp, synthetic construct
  source 1..145: mol_type = other DNA
tgggtcgtagcgaactgagagttttagagctagaaatagcaagttaaaataaggctagtccgttatcaacttgaaaaagtggcaccgagtcggtgcggtcttaggaactttgctgccacaatacctcggcccttctcagttcgct

SEQ ID NO: 33768 - DNA, 146 bp, synthetic construct
  source 1..146: mol_type = other DNA
tgggtcgtagcgaactgagagttttagagctagaaatagcaagttaaaataaggctagtccgttatcaacttgaaaaagtggcaccgagtcggtgctggtcttaggaactttgctgccacaatacctcggcccttctcagttcgct

SEQ ID NO: 33769 - DNA, 147 bp, synthetic construct
  source 1..147: mol_type = other DNA
tgggtcgtagcgaactgagagttttagagctagaaatagcaagttaaaataaggctagtccgttatcaacttgaaaaagtggcaccgagtcggtgcttggtcttaggaactttgctgccacaatacctcggcccttctcagttcgct

SEQ ID NO: 33770 - DNA, 148 bp, synthetic construct
  source 1..148: mol_type = other DNA
tgggtcgtagcgaactgagagttttagagctagaaatagcaagttaaaataaggctagtccgttatcaacttgaaaaagtggcaccgagtcggtgctttggtcttaggaactttgctgccacaatacctcggcccttctcagttcgct

SEQ ID NO: 33771 - DNA, 149 bp, synthetic construct
  source 1..149: mol_type = other DNA
tgggtcgtagcgaactgagagttttagagctagaaatagcaagttaaaataaggctagtccgttatcaacttgaaaaagtggcaccgagtcggtgcttttggtcttaggaactttgctgccacaatacctcggcccttctcagttcgct

SEQ ID NO: 33772 - DNA, 150 bp, synthetic construct
  source 1..150: mol_type = other DNA
tgggtcgtagcgaactgagagttttagagctagaaatagcaagttaaaataaggctagtccgttatcaacttgaaaaagtggcaccgagtcggtgcgttttggtcttaggaactttgctgccacaatacctcggcccttctcagttcgct

SEQ ID NO: 33773 - DNA, 151 bp, synthetic construct
  source 1..151: mol_type = other DNA
tgggtcgtagcgaactgagagttttagagctagaaatagcaagttaaaataaggctagtccgttatcaacttgaaaaagtggcaccgagtcggtgcggttttggtcttaggaactttgctgccacaatacctcggcccttctcagttcgct

SEQ ID NO: 33774 - DNA, 152 bp, synthetic construct
  source 1..152: mol_type = other DNA
tgggtcgtagcgaactgagagttttagagctagaaatagcaagttaaaataaggctagtccgttatcaacttgaaaaagtggcaccgagtcggtgctggttttggtcttaggaactttgctgccacaatacctcggcccttctcagttcgct

SEQ ID NO: 33775 - DNA, 153 bp, synthetic construct
  source 1..153: mol_type = other DNA
tgggtcgtagcgaactgagagttttagagctagaaatagcaagttaaaataaggctagtccgttatcaacttgaaaaagtggcaccgagtcggtgcgtggttttggtcttaggaactttgctgccacaatacctcggcccttctcagttcgct

SEQ ID NO: 33776 - DNA, 154 bp, synthetic construct
  source 1..154: mol_type = other DNA
tgggtcgtagcgaactgagagttttagagctagaaatagcaagttaaaataaggctagtccgttatcaacttgaaaaagtggcaccgagtcggtgctgtggttttggtcttaggaactttgctgccacaatacctcggcccttctcagttcgct

SEQ ID NO: 33777 - DNA, 155 bp, synthetic construct
  source 1..155: mol_type = other DNA
tgggtcgtagcgaactgagagttttagagctagaaatagcaagttaaaataaggctagtccgttatcaacttgaaaaagtggcaccgagtcggtgcctgtggttttggtcttaggaactttgctgccacaatacctcggcccttctcagttcgct

SEQ ID NO: 33778 - DNA, 156 bp, synthetic construct
  source 1..156: mol_type = other DNA
tgggtcgtagcgaactgagagttttagagctagaaatagcaagttaaaataaggctagtccgttatcaacttgaaaaagtggcaccgagtcggtgccctgtggttttggtcttaggaactttgctgccacaatacctcggcccttctcagttcgct

SEQ ID NO: 33779 - DNA, 157 bp, synthetic construct
  source 1..157: mol_type = other DNA
tgggtcgtagcgaactgagagttttagagctagaaatagcaagttaaaataaggctagtccgttatcaacttgaaaaagtggcaccgagtcggtgcgcctgtggttttggtcttaggaactttgctgccacaatacctcggcccttctcagttcgct

SEQ ID NO: 33780 - DNA, 158 bp, synthetic construct
  source 1..158: mol_type = other DNA
tgggtcgtagcgaactgagagttttagagctagaaatagcaagttaaaataaggctagtccgttatcaacttgaaaaagtggcaccgagtcggtgcagcctgtggttttggtcttaggaactttgctgccacaatacctcggcccttctcagttcgct

SEQ ID NO: 33781 - DNA, 159 bp, synthetic construct
  source 1..159: mol_type = other DNA
tgggtcgtagcgaactgagagttttagagctagaaatagcaagttaaaataaggctagtccgttatcaacttgaaaaagtggcaccgagtcggtgcaagcctgtggttttggtcttaggaactttgctgccacaatacctcggcccttctcagttcgct

SEQ ID NO: 33782 - DNA, 160 bp, synthetic construct
  source 1..160: mol_type = other DNA
tgggtcgtagcgaactgagagttttagagctagaaatagcaagttaaaataaggctagtccgttatcaacttgaaaaagtggcaccgagtcggtgccaagcctgtggttttggtcttaggaactttgctgccacaatacctcggcccttctcagttcgct

SEQ ID NO: 33783 - DNA, 161 bp, synthetic construct
  source 1..161: mol_type = other DNA
tgggtcgtagcgaactgagagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgct

SEQ ID NO: 33784 - DNA, 162 bp, synthetic construct
  source 1..162: mol_type = other DNA
tgggtcgtagcgaactgagagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgct

SEQ ID NO: 33785 - DNA, 163 bp, synthetic construct
  source 1..163: mol_type = other DNA
tgggtcgtagcgaactgagagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgct

SEQ ID NO: 33786 - DNA, 164 bp, synthetic construct
  source 1..164: mol_type = other DNA
tgggtcgtagcgaactgagagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgct

SEQ ID NO: 33787 - DNA, 165 bp, synthetic construct
  source 1..165: mol_type = other DNA
tgggtcgtagcgaactgagagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgct

SEQ ID NO: 33788 - DNA, 106 bp, synthetic construct
  source 1..106: mol_type = other DNA
gggtcgtagcgaactgagaagttttagagctagaaatagcaagttaaaataaggctagtccgttatcaacttgaaaaagtggcaccgagtcggtgctcggcccttc

SEQ ID NO: 33789 - DNA, 107 bp, synthetic construct
  source 1..107: mol_type = other DNA
gggtcgtagcgaactgagaagttttagagctagaaatagcaagttaaaataaggctagtccgttatcaacttgaaaaagtggcaccgagtcggtgcctcggcccttc

SEQ ID NO: 33790 - DNA, 108 bp, synthetic construct
  source 1..108: mol_type = other DNA
gggtcgtagcgaactgagaagttttagagctagaaatagcaagttaaaataaggctagtccgttatcaacttgaaaaagtggcaccgagtcggtgccctcggcccttc

SEQ ID NO: 33791 - DNA, 109 bp, synthetic construct
  source 1..109: mol_type = other DNA
gggtcgtagcgaactgagaagttttagagctagaaatagcaagttaaaataaggctagtccgttatcaacttgaaaaagtggcaccgagtcggtgcacctcggcccttc

SEQ ID NO: 33792 - DNA, 110 bp, synthetic construct
  source 1..110: mol_type = other DNA
gggtcgtagcgaactgagaagttttagagctagaaatagcaagttaaaataaggctagtccgttatcaacttgaaaaagtggcaccgagtcggtgctacctcggcccttc

SEQ ID NO: 33793 - DNA, 111 bp, synthetic construct
  source 1..111: mol_type = other DNA
gggtcgtagcgaactgagaagttttagagctagaaatagcaagttaaaataaggctagtccgttatcaacttgaaaaagtggcaccgagtcggtgcatacctcggcccttc

SEQ ID NO: 33794 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgcaatacctcggcccttc

SEQ ID NO: 33795 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgccaatacctcggcccttc

SEQ ID NO: 33796 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgcacaatacctcggcccttc

SEQ ID NO: 33797 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgccacaatacctcggcccttc

SEQ ID NO: 33798 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgcccacaatacctcggcccttc

SEQ ID NO: 33799 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgcgccacaatacctcggcccttc

SEQ ID NO: 33800 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgctgccacaatacctcggcccttc

SEQ ID NO: 33801 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcctgccacaatacctcggcccttc

SEQ ID NO: 33802 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttc

SEQ ID NO: 33803 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttc

SEQ ID NO: 33804 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttc

SEQ ID NO: 33805 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttc

SEQ ID NO: 33806 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttc

SEQ ID NO: 33807 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttc

SEQ ID NO: 33808 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttc

SEQ ID NO: 33809 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttc

SEQ ID NO: 33810 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttc

SEQ ID NO: 33811 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttc

SEQ ID NO: 33812 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttc

SEQ ID NO: 33813 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttc

SEQ ID NO: 33814 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttc

SEQ ID NO: 33815 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttc

SEQ ID NO: 33816 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttc

SEQ ID NO: 33817 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttc

SEQ ID NO: 33818 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttc

SEQ ID NO: 33819 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttc

SEQ ID NO: 33820 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttc

SEQ ID NO: 33821 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttc

SEQ ID NO: 33822 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttc

SEQ ID NO: 33823 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttc

SEQ ID NO: 33824 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttc

SEQ ID NO: 33825 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttc

SEQ ID NO: 33826 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttc

SEQ ID NO: 33827 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttc

SEQ ID NO: 33828 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttc

SEQ ID NO: 33829 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttc

SEQ ID NO: 33830 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttc

SEQ ID NO: 33831 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttc

SEQ ID NO: 33832 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttc

SEQ ID NO: 33833 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttc

SEQ ID NO: 33834 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttc

SEQ ID NO: 33835 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttc

SEQ ID NO: 33836 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttc

SEQ ID NO: 33837 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttc

SEQ ID NO: 33838 - DNA, 105 bp, synthetic construct
  source 1..105: mol_type = other DNA
gggtcgtagcgaactgagaagttttagagctagaaatagcaagttaaaataaggctagtccgttatcaacttgaaaaagtggcaccgagtcggtgccggcccttc

SEQ ID NO: 33839 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgctcggcccttctcagttcgct

SEQ ID NO: 33840 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgcctcggcccttctcagttcgct

SEQ ID NO: 33841 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgccctcggcccttctcagttcgct

SEQ ID NO: 33842 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcacctcggcccttctcagttcgct

SEQ ID NO: 33843 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgctacctcggcccttctcagttcgct

SEQ ID NO: 33844 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgct

SEQ ID NO: 33845 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgct

SEQ ID NO: 33846 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgct

SEQ ID NO: 33847 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgct

SEQ ID NO: 33848 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgct

SEQ ID NO: 33849 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgct

SEQ ID NO: 33850 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgct

SEQ ID NO: 33851 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgct

SEQ ID NO: 33852 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgct

SEQ ID NO: 33853 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgct

SEQ ID NO: 33854 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgct

SEQ ID NO: 33855 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgct

SEQ ID NO: 33856 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgct

SEQ ID NO: 33857 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgct

SEQ ID NO: 33858 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgct

SEQ ID NO: 33859 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgct

SEQ ID NO: 33860 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgct

SEQ ID NO: 33861 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgct

SEQ ID NO: 33862 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgct

SEQ ID NO: 33863 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgct

SEQ ID NO: 33864 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgct

SEQ ID NO: 33865 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgct

SEQ ID NO: 33866 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgct

SEQ ID NO: 33867 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgct

SEQ ID NO: 33868 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgct

SEQ ID NO: 33869 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgct

SEQ ID NO: 33870 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgct

SEQ ID NO: 33871 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgct

SEQ ID NO: 33872 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgct

SEQ ID NO: 33873 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgct

SEQ ID NO: 33874 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgct

SEQ ID NO: 33875 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgct

SEQ ID NO: 33876 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgct

SEQ ID NO: 33877 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgct

SEQ ID NO: 33878 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgct

SEQ ID NO: 33879 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgct

SEQ ID NO: 33880 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgct

SEQ ID NO: 33881 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgct

SEQ ID NO: 33882 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgct

SEQ ID NO: 33883 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgct

SEQ ID NO: 33884 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgct

SEQ ID NO: 33885 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgct

SEQ ID NO: 33886 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgct

SEQ ID NO: 33887 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgct

SEQ ID NO: 33888 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgct

SEQ ID NO: 33889 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgccggcccttctcagttcgct

SEQ ID NO: 33890 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgctcggcccttctcagttcgcta

SEQ ID NO: 33891 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgcctcggcccttctcagttcgcta

SEQ ID NO: 33892 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgccctcggcccttctcagttcgcta

SEQ ID NO: 33893 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcacctcggcccttctcagttcgcta

SEQ ID NO: 33894 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgctacctcggcccttctcagttcgcta

SEQ ID NO: 33895 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgcta

SEQ ID NO: 33896 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgcta

SEQ ID NO: 33897 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgcta

SEQ ID NO: 33898 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgcta

SEQ ID NO: 33899 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgcta

SEQ ID NO: 33900 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgcta

SEQ ID NO: 33901 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgcta

SEQ ID NO: 33902 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgcta

SEQ ID NO: 33903 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgcta

SEQ ID NO: 33904 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgcta

SEQ ID NO: 33905 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgcta

SEQ ID NO: 33906 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgcta

SEQ ID NO: 33907 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgcta

SEQ ID NO: 33908 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgcta

SEQ ID NO: 33909 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgcta

SEQ ID NO: 33910 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgcta

SEQ ID NO: 33911 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgcta

SEQ ID NO: 33912 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgcta

SEQ ID NO: 33913 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgcta

SEQ ID NO: 33914 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgcta

SEQ ID NO: 33915 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgcta

SEQ ID NO: 33916 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgcta

SEQ ID NO: 33917 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgcta

SEQ ID NO: 33918 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgcta

SEQ ID NO: 33919 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgcta

SEQ ID NO: 33920 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgcta

SEQ ID NO: 33921 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgcta

SEQ ID NO: 33922 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgcta

SEQ ID NO: 33923 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgcta

SEQ ID NO: 33924 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgcta

SEQ ID NO: 33925 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgcta

SEQ ID NO: 33926 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgcta

SEQ ID NO: 33927 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgcta

SEQ ID NO: 33928 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgcta

SEQ ID NO: 33929 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgcta

SEQ ID NO: 33930 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgcta

SEQ ID NO: 33931 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgcta

SEQ ID NO: 33932 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgcta

SEQ ID NO: 33933 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgcta

SEQ ID NO: 33934 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgcta

SEQ ID NO: 33935 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgcta

SEQ ID NO: 33936 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgcta

SEQ ID NO: 33937 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgcta

SEQ ID NO: 33938 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgcta

SEQ ID NO: 33939 - DNA, 166 bp, synthetic construct
  source 1..166: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgcta

SEQ ID NO: 33940 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgccggcccttctcagttcgcta

SEQ ID NO: 33941 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgctcggcccttctcagttcgctac

SEQ ID NO: 33942 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcctcggcccttctcagttcgctac

SEQ ID NO: 33943 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgccctcggcccttctcagttcgctac

SEQ ID NO: 33944 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcacctcggcccttctcagttcgctac

SEQ ID NO: 33945 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgctacctcggcccttctcagttcgctac

SEQ ID NO: 33946 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgctac

SEQ ID NO: 33947 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgctac

SEQ ID NO: 33948 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgctac

SEQ ID NO: 33949 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgctac

SEQ ID NO: 33950 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgctac

SEQ ID NO: 33951 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgctac

SEQ ID NO: 33952 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgctac

SEQ ID NO: 33953 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgctac

SEQ ID NO: 33954 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgctac

SEQ ID NO: 33955 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgctac

SEQ ID NO: 33956 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgctac

SEQ ID NO: 33957 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgctac

SEQ ID NO: 33958 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgctac

SEQ ID NO: 33959 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgctac

SEQ ID NO: 33960 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgctac

SEQ ID NO: 33961 - DNA, 138 bp, synthetic construct; identical to SEQ ID NO: 29062
  source 1..138: mol_type = other DNA

SEQ ID NO: 33962 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgctac

SEQ ID NO: 33963 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgctac

SEQ ID NO: 33964 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgctac

SEQ ID NO: 33965 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgctac

SEQ ID NO: 33966 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgctac

SEQ ID NO: 33967 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgctac

SEQ ID NO: 33968 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgctac

SEQ ID NO: 33969 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgctac

SEQ ID NO: 33970 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgctac

SEQ ID NO: 33971 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgctac

SEQ ID NO: 33972 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgctac

SEQ ID NO: 33973 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgctac

SEQ ID NO: 33974 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgctac

SEQ ID NO: 33975 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgctac

SEQ ID NO: 33976 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgctac

SEQ ID NO: 33977 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgctac

SEQ ID NO: 33978 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgctac

SEQ ID NO: 33979 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgctac

SEQ ID NO: 33980 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgctac

SEQ ID NO: 33981 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgctac

SEQ ID NO: 33982 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgctac

SEQ ID NO: 33983 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgctac

SEQ ID NO: 33984 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctac

SEQ ID NO: 33985 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctac

SEQ ID NO: 33986 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctac

SEQ ID NO: 33987 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctac

SEQ ID NO: 33988 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctac

SEQ ID NO: 33989 - DNA, 166 bp, synthetic construct
  source 1..166: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctac

SEQ ID NO: 33990 - DNA, 167 bp, synthetic construct
  source 1..167: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctac

SEQ ID NO: 33991 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgccggcccttctcagttcgctac

SEQ ID NO: 33992 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgctcggcccttctcagttcgctacg

SEQ ID NO: 33993 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcctcggcccttctcagttcgctacg

SEQ ID NO: 33994 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgccctcggcccttctcagttcgctacg

SEQ ID NO: 33995 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcacctcggcccttctcagttcgctacg

SEQ ID NO: 33996 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgctacctcggcccttctcagttcgctacg

SEQ ID NO: 33997 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgctacg

SEQ ID NO: 33998 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgctacg

SEQ ID NO: 33999 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgctacg

SEQ ID NO: 34000 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgctacg

SEQ ID NO: 34001 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgctacg

SEQ ID NO: 34002 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgctacg

SEQ ID NO: 34003 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgctacg

SEQ ID NO: 34004 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgctacg

SEQ ID NO: 34005 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgctacg

SEQ ID NO: 34006 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgctacg

SEQ ID NO: 34007 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgctacg

SEQ ID NO: 34008 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgctacg

SEQ ID NO: 34009 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgctacg

SEQ ID NO: 34010 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgctacg

SEQ ID NO: 34011 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgctacg

SEQ ID NO: 34012 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgctacg

SEQ ID NO: 34013 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgctacg

SEQ ID NO: 34014 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgctacg

SEQ ID NO: 34015 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgctacg

SEQ ID NO: 34016 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgctacg

SEQ ID NO: 34017 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgctacg

SEQ ID NO: 34018 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgctacg

SEQ ID NO: 34019 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgctacg

SEQ ID NO: 34020 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgctacg

SEQ ID NO: 34021 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgctacg

SEQ ID NO: 34022 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgctacg

SEQ ID NO: 34023 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgctacg

SEQ ID NO: 34024 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgctacg

SEQ ID NO: 34025 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgctacg

SEQ ID NO: 34026 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgctacg

SEQ ID NO: 34027 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgctacg

SEQ ID NO: 34028 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgctacg

SEQ ID NO: 34029 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgctacg

SEQ ID NO: 34030 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgctacg

SEQ ID NO: 34031 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgctacg

SEQ ID NO: 34032 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgctacg

SEQ ID NO: 34033 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacg

SEQ ID NO: 34034 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacg

SEQ ID NO: 34035 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacg

SEQ ID NO: 34036 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacg

SEQ ID NO: 34037 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacg

SEQ ID NO: 34038 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacg

SEQ ID NO: 34039 - DNA, 166 bp, synthetic construct
  source 1..166: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacg

SEQ ID NO: 34040 - DNA, 167 bp, synthetic construct
  source 1..167: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacg

SEQ ID NO: 34041 - DNA, 168 bp, synthetic construct
  source 1..168: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacg

SEQ ID NO: 34042 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgccggcccttctcagttcgctacg

SEQ ID NO: 34043 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgctcggcccttctcagttcgctacga

SEQ ID NO: 34044 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcctcggcccttctcagttcgctacga

SEQ ID NO: 34045 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgccctcggcccttctcagttcgctacga

SEQ ID NO: 34046 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcacctcggcccttctcagttcgctacga

SEQ ID NO: 34047 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgctacctcggcccttctcagttcgctacga

SEQ ID NO: 34048 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgctacga

SEQ ID NO: 34049 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgctacga

SEQ ID NO: 34050 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgctacga

SEQ ID NO: 34051 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgctacga

SEQ ID NO: 34052 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgctacga

SEQ ID NO: 34053 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgctacga

SEQ ID NO: 34054 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgctacga

SEQ ID NO: 34055 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgctacga

SEQ ID NO: 34056 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgctacga

SEQ ID NO: 34057 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgctacga

SEQ ID NO: 34058 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgctacga

SEQ ID NO: 34059 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgctacga

SEQ ID NO: 34060 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgctacga

SEQ ID NO: 34061 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgctacga

SEQ ID NO: 34062 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgctacga

SEQ ID NO: 34063 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgctacga

SEQ ID NO: 34064 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgctacga

SEQ ID NO: 34065 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgctacga

SEQ ID NO: 34066 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgctacga

SEQ ID NO: 34067 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgctacga

SEQ ID NO: 34068 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgctacga

SEQ ID NO: 34069 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgctacga

SEQ ID NO: 34070 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgctacga

SEQ ID NO: 34071 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgctacga

SEQ ID NO: 34072 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgctacga

SEQ ID NO: 34073 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgctacga

SEQ ID NO: 34074 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgctacga

SEQ ID NO: 34075 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgctacga

SEQ ID NO: 34076 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgctacga

SEQ ID NO: 34077 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgctacga

SEQ ID NO: 34078 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgctacga

SEQ ID NO: 34079 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgctacga

SEQ ID NO: 34080 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgctacga

SEQ ID NO: 34081 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgctacga

SEQ ID NO: 34082 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgctacga

SEQ ID NO: 34083 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgctacga

SEQ ID NO: 34084 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacga

SEQ ID NO: 34085 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacga

SEQ ID NO: 34086 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacga

SEQ ID NO: 34087 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacga

SEQ ID NO: 34088 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacga

SEQ ID NO: 34089 - DNA, 166 bp, synthetic construct
  source 1..166: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacga

SEQ ID NO: 34090 - DNA, 167 bp, synthetic construct
  source 1..167: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacga

SEQ ID NO: 34091 - DNA, 168 bp, synthetic construct
  source 1..168: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacga

SEQ ID NO: 34092 - DNA, 169 bp, synthetic construct
  source 1..169: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacga

SEQ ID NO: 34093 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgccggcccttctcagttcgctacga

SEQ ID NO: 34094 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgctcggcccttctcagttcgctacgac

SEQ ID NO: 34095 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcctcggcccttctcagttcgctacgac

SEQ ID NO: 34096 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgccctcggcccttctcagttcgctacgac

SEQ ID NO: 34097 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcacctcggcccttctcagttcgctacgac

SEQ ID NO: 34098 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgctacctcggcccttctcagttcgctacgac

SEQ ID NO: 34099 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgctacgac

SEQ ID NO: 34100 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgctacgac

SEQ ID NO: 34101 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgctacgac

SEQ ID NO: 34102 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgctacgac

SEQ ID NO: 34103 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgctacgac

SEQ ID NO: 34104 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgctacgac

SEQ ID NO: 34105 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgctacgac

SEQ ID NO: 34106 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgctacgac

SEQ ID NO: 34107 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgctacgac

SEQ ID NO: 34108 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgctacgac

SEQ ID NO: 34109 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgctacgac

SEQ ID NO: 34110 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgctacgac

SEQ ID NO: 34111 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgctacgac

SEQ ID NO: 34112 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgctacgac

SEQ ID NO: 34113 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgctacgac

SEQ ID NO: 34114 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgctacgac

SEQ ID NO: 34115 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgctacgac

SEQ ID NO: 34116 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgctacgac

SEQ ID NO: 34117 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgctacgac

SEQ ID NO: 34118 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgctacgac

SEQ ID NO: 34119 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgctacgac

SEQ ID NO: 34120 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgctacgac

SEQ ID NO: 34121 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgctacgac

SEQ ID NO: 34122 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgctacgac

SEQ ID NO: 34123 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgctacgac

SEQ ID NO: 34124 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgctacgac

SEQ ID NO: 34125 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgctacgac

SEQ ID NO: 34126 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgctacgac

SEQ ID NO: 34127 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgctacgac

SEQ ID NO: 34128 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgctacgac

SEQ ID NO: 34129 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgctacgac

SEQ ID NO: 34130 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgctacgac

SEQ ID NO: 34131 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgctacgac

SEQ ID NO: 34132 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgctacgac

SEQ ID NO: 34133 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgctacgac

SEQ ID NO: 34134 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgctacgac

SEQ ID NO: 34135 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgac

SEQ ID NO: 34136 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgac

SEQ ID NO: 34137 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgac

SEQ ID NO: 34138 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgac

SEQ ID NO: 34139 - DNA, 166 bp, synthetic construct
  source 1..166: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgac

SEQ ID NO: 34140 - DNA, 167 bp, synthetic construct
  source 1..167: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgac

SEQ ID NO: 34141 - DNA, 168 bp, synthetic construct
  source 1..168: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgac

SEQ ID NO: 34142 - DNA, 169 bp, synthetic construct
  source 1..169: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgac

SEQ ID NO: 34143 - DNA, 170 bp, synthetic construct
  source 1..170: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgac

SEQ ID NO: 34144 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgccggcccttctcagttcgctacgac

SEQ ID NO: 34145 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgctcggcccttctcagttcgctacgacc

SEQ ID NO: 34146 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcctcggcccttctcagttcgctacgacc

SEQ ID NO: 34147 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgccctcggcccttctcagttcgctacgacc

SEQ ID NO: 34148 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcacctcggcccttctcagttcgctacgacc

SEQ ID NO: 34149 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctacctcggcccttctcagttcgctacgacc

SEQ ID NO: 34150 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgctacgacc

SEQ ID NO: 34151 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgctacgacc

SEQ ID NO: 34152 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgctacgacc

SEQ ID NO: 34153 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgctacgacc

SEQ ID NO: 34154 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgctacgacc

SEQ ID NO: 34155 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgctacgacc

SEQ ID NO: 34156 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgctacgacc

SEQ ID NO: 34157 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgctacgacc

SEQ ID NO: 34158 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgctacgacc

SEQ ID NO: 34159 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgctacgacc

SEQ ID NO: 34160 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgctacgacc

SEQ ID NO: 34161 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgctacgacc

SEQ ID NO: 34162 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgctacgacc

SEQ ID NO: 34163 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgctacgacc

SEQ ID NO: 34164 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgctacgacc

SEQ ID NO: 34165 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgctacgacc

SEQ ID NO: 34166 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgctacgacc

SEQ ID NO: 34167 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgctacgacc

SEQ ID NO: 34168 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgctacgacc

SEQ ID NO: 34169 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgctacgacc

SEQ ID NO: 34170 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgctacgacc

SEQ ID NO: 34171 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgctacgacc

SEQ ID NO: 34172 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgctacgacc

SEQ ID NO: 34173 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgctacgacc

SEQ ID NO: 34174 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgctacgacc

SEQ ID NO: 34175 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgctacgacc

SEQ ID NO: 34176 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgctacgacc

SEQ ID NO: 34177 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgctacgacc

SEQ ID NO: 34178 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgctacgacc

SEQ ID NO: 34179 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgctacgacc

SEQ ID NO: 34180 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgctacgacc

SEQ ID NO: 34181 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgctacgacc

SEQ ID NO: 34182 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgctacgacc

SEQ ID NO: 34183 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgctacgacc

SEQ ID NO: 34184 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgctacgacc

SEQ ID NO: 34185 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgctacgacc

SEQ ID NO: 34186 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgacc

SEQ ID NO: 34187 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgacc

SEQ ID NO: 34188 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgacc

SEQ ID NO: 34189 - DNA, 166 bp, synthetic construct
  source 1..166: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgacc

SEQ ID NO: 34190 - DNA, 167 bp, synthetic construct
  source 1..167: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgacc

SEQ ID NO: 34191 - DNA, 168 bp, synthetic construct
  source 1..168: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgacc

SEQ ID NO: 34192 - DNA, 169 bp, synthetic construct
  source 1..169: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgacc

SEQ ID NO: 34193 - DNA, 170 bp, synthetic construct
  source 1..170: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgacc

SEQ ID NO: 34194 - DNA, 171 bp, synthetic construct
  source 1..171: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgacc

SEQ ID NO: 34195 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgccggcccttctcagttcgctacgacc

SEQ ID NO: 34196 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgctcggcccttctcagttcgctacgaccc

SEQ ID NO: 34197 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcctcggcccttctcagttcgctacgaccc

SEQ ID NO: 34198 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgccctcggcccttctcagttcgctacgaccc

SEQ ID NO: 34199 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcacctcggcccttctcagttcgctacgaccc

SEQ ID NO: 34200 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctacctcggcccttctcagttcgctacgaccc

SEQ ID NO: 34201 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgctacgaccc

SEQ ID NO: 34202 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgctacgaccc

SEQ ID NO: 34203 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgctacgaccc

SEQ ID NO: 34204 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgctacgaccc

SEQ ID NO: 34205 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgctacgaccc

SEQ ID NO: 34206 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgctacgaccc

SEQ ID NO: 34207 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgctacgaccc

SEQ ID NO: 34208 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgctacgaccc

SEQ ID NO: 34209 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgctacgaccc

SEQ ID NO: 34210 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgctacgaccc

SEQ ID NO: 34211 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgctacgaccc

SEQ ID NO: 34212 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgctacgaccc

SEQ ID NO: 34213 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgctacgaccc

SEQ ID NO: 34214 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgctacgaccc

SEQ ID NO: 34215 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgctacgaccc

SEQ ID NO: 34216 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgctacgaccc

SEQ ID NO: 34217 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgctacgaccc

SEQ ID NO: 34218 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgctacgaccc

SEQ ID NO: 34219 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgctacgaccc

SEQ ID NO: 34220 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgctacgaccc

SEQ ID NO: 34221 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgctacgaccc

SEQ ID NO: 34222 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgctacgaccc

SEQ ID NO: 34223 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgctacgaccc

SEQ ID NO: 34224 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgctacgaccc

SEQ ID NO: 34225 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgctacgaccc

SEQ ID NO: 34226 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgctacgaccc

SEQ ID NO: 34227 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgctacgaccc

SEQ ID NO: 34228 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgctacgaccc

SEQ ID NO: 34229 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgctacgaccc

SEQ ID NO: 34230 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgctacgaccc

SEQ ID NO: 34231 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgctacgaccc

SEQ ID NO: 34232 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgctacgaccc

SEQ ID NO: 34233 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgctacgaccc

SEQ ID NO: 34234 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgctacgaccc

SEQ ID NO: 34235 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgctacgaccc

SEQ ID NO: 34236 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgctacgaccc

SEQ ID NO: 34237 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgctacgaccc

SEQ ID NO: 34238 - DNA, 165 bp, synthetic construct
  source 1..165: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgctacgaccc

SEQ ID NO: 34239 - DNA, 166 bp, synthetic construct
  source 1..166: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgctacgaccc

SEQ ID NO: 34240 - DNA, 167 bp, synthetic construct
  source 1..167: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgctacgaccc

SEQ ID NO: 34241 - DNA, 168 bp, synthetic construct
  source 1..168: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgctacgaccc

SEQ ID NO: 34242 - DNA, 169 bp, synthetic construct
  source 1..169: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgctacgaccc

SEQ ID NO: 34243 - DNA, 170 bp, synthetic construct
  source 1..170: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgctacgaccc

SEQ ID NO: 34244 - DNA, 171 bp, synthetic construct
  source 1..171: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgctacgaccc

SEQ ID NO: 34245 - DNA, 172 bp, synthetic construct
  source 1..172: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgctacgaccc

SEQ ID NO: 34246 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgccggcccttctcagttcgctacgaccc

SEQ ID NO: 34247 - DNA, 107 bp, synthetic construct
  source 1..107: mol_type = other DNA
gggtcgtagcgaactgagaagttttagagctagaaatagcaagttaaaataaggctagtccgttatcaacttgaaaaagtggcaccgagtcggtgctcggcccttct

SEQ ID NO: 34248 - DNA, 108 bp, synthetic construct
  source 1..108: mol_type = other DNA
gggtcgtagcgaactgagaagttttagagctagaaatagcaagttaaaataaggctagtccgttatcaacttgaaaaagtggcaccgagtcggtgcctcggcccttct

SEQ ID NO: 34249 - DNA, 109 bp, synthetic construct
  source 1..109: mol_type = other DNA
gggtcgtagcgaactgagaagttttagagctagaaatagcaagttaaaataaggctagtccgttatcaacttgaaaaagtggcaccgagtcggtgccctcggcccttct

SEQ ID NO: 34250 - DNA, 110 bp, synthetic construct
  source 1..110: mol_type = other DNA
gggtcgtagcgaactgagaagttttagagctagaaatagcaagttaaaataaggctagtccgttatcaacttgaaaaagtggcaccgagtcggtgcacctcggcccttct

SEQ ID NO: 34251 - DNA, 111 bp, synthetic construct
  source 1..111: mol_type = other DNA
gggtcgtagcgaactgagaagttttagagctagaaatagcaagttaaaataaggctagtccgttatcaacttgaaaaagtggcaccgagtcggtgctacctcggcccttct

SEQ ID NO: 34252 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgcatacctcggcccttct

SEQ ID NO: 34253 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgcaatacctcggcccttct

SEQ ID NO: 34254 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgccaatacctcggcccttct

SEQ ID NO: 34255 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgcacaatacctcggcccttct

SEQ ID NO: 34256 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgccacaatacctcggcccttct

SEQ ID NO: 34257 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgcccacaatacctcggcccttct

SEQ ID NO: 34258 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgcgccacaatacctcggcccttct

SEQ ID NO: 34259 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgctgccacaatacctcggcccttct

SEQ ID NO: 34260 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcctgccacaatacctcggcccttct

SEQ ID NO: 34261 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttct

SEQ ID NO: 34262 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttct

SEQ ID NO: 34263 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttct

SEQ ID NO: 34264 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttct

SEQ ID NO: 34265 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttct

SEQ ID NO: 34266 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttct

SEQ ID NO: 34267 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttct

SEQ ID NO: 34268 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttct

SEQ ID NO: 34269 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttct

SEQ ID NO: 34270 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttct

SEQ ID NO: 34271 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttct

SEQ ID NO: 34272 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttct

SEQ ID NO: 34273 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttct

SEQ ID NO: 34274 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttct

SEQ ID NO: 34275 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttct

SEQ ID NO: 34276 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttct

SEQ ID NO: 34277 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttct

SEQ ID NO: 34278 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttct

SEQ ID NO: 34279 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttct

SEQ ID NO: 34280 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttct

SEQ ID NO: 34281 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttct

SEQ ID NO: 34282 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttct

SEQ ID NO: 34283 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttct

SEQ ID NO: 34284 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttct

SEQ ID NO: 34285 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttct

SEQ ID NO: 34286 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttct

SEQ ID NO: 34287 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttct

SEQ ID NO: 34288 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttct

SEQ ID NO: 34289 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttct

SEQ ID NO: 34290 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttct

SEQ ID NO: 34291 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttct

SEQ ID NO: 34292 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttct

SEQ ID NO: 34293 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttct

SEQ ID NO: 34294 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttct

SEQ ID NO: 34295 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttct

SEQ ID NO: 34296 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttct

SEQ ID NO: 34297 - DNA, 106 bp, synthetic construct
  source 1..106: mol_type = other DNA
gggtcgtagcgaactgagaagttttagagctagaaatagcaagttaaaataaggctagtccgttatcaacttgaaaaagtggcaccgagtcggtgccggcccttct

SEQ ID NO: 34298 - DNA, 108 bp, synthetic construct
  source 1..108: mol_type = other DNA
gggtcgtagcgaactgagaagttttagagctagaaatagcaagttaaaataaggctagtccgttatcaacttgaaaaagtggcaccgagtcggtgctcggcccttctc

SEQ ID NO: 34299 - DNA, 109 bp, synthetic construct
  source 1..109: mol_type = other DNA
gggtcgtagcgaactgagaagttttagagctagaaatagcaagttaaaataaggctagtccgttatcaacttgaaaaagtggcaccgagtcggtgcctcggcccttctc

SEQ ID NO: 34300 - DNA, 110 bp, synthetic construct
  source 1..110: mol_type = other DNA
gggtcgtagcgaactgagaagttttagagctagaaatagcaagttaaaataaggctagtccgttatcaacttgaaaaagtggcaccgagtcggtgccctcggcccttctc

SEQ ID NO: 34301 - DNA, 111 bp, synthetic construct
  source 1..111: mol_type = other DNA
gggtcgtagcgaactgagaagttttagagctagaaatagcaagttaaaataaggctagtccgttatcaacttgaaaaagtggcaccgagtcggtgcacctcggcccttctc

SEQ ID NO: 34302 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgctacctcggcccttctc

SEQ ID NO: 34303 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgcatacctcggcccttctc

SEQ ID NO: 34304 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgcaatacctcggcccttctc

SEQ ID NO: 34305 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgccaatacctcggcccttctc

SEQ ID NO: 34306 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgcacaatacctcggcccttctc

SEQ ID NO: 34307 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgccacaatacctcggcccttctc

SEQ ID NO: 34308 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgcccacaatacctcggcccttctc

SEQ ID NO: 34309 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcgccacaatacctcggcccttctc

SEQ ID NO: 34310 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgctgccacaatacctcggcccttctc

SEQ ID NO: 34311 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctc

SEQ ID NO: 34312 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctc

SEQ ID NO: 34313 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctc

SEQ ID NO: 34314 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctc

SEQ ID NO: 34315 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctc

SEQ ID NO: 34316 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctc

SEQ ID NO: 34317 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctc

SEQ ID NO: 34318 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctc

SEQ ID NO: 34319 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctc

SEQ ID NO: 34320 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctc

SEQ ID NO: 34321 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctc

SEQ ID NO: 34322 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctc

SEQ ID NO: 34323 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctc

SEQ ID NO: 34324 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctc

SEQ ID NO: 34325 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctc

SEQ ID NO: 34326 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctc

SEQ ID NO: 34327 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctc

SEQ ID NO: 34328 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctc

SEQ ID NO: 34329 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctc

SEQ ID NO: 34330 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctc

SEQ ID NO: 34331 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctc

SEQ ID NO: 34332 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctc

SEQ ID NO: 34333 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctc

SEQ ID NO: 34334 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctc

SEQ ID NO: 34335 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctc

SEQ ID NO: 34336 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctc

SEQ ID NO: 34337 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctc

SEQ ID NO: 34338 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctc

SEQ ID NO: 34339 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctc

SEQ ID NO: 34340 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctc

SEQ ID NO: 34341 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctc

SEQ ID NO: 34342 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctc

SEQ ID NO: 34343 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctc

SEQ ID NO: 34344 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctc

SEQ ID NO: 34345 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctc

SEQ ID NO: 34346 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctc

SEQ ID NO: 34347 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctc

SEQ ID NO: 34348 - DNA, 107 bp, synthetic construct
  source 1..107: mol_type = other DNA
gggtcgtagcgaactgagaagttttagagctagaaatagcaagttaaaataaggctagtccgttatcaacttgaaaaagtggcaccgagtcggtgccggcccttctc

SEQ ID NO: 34349 - DNA, 109 bp, synthetic construct
  source 1..109: mol_type = other DNA
gggtcgtagcgaactgagaagttttagagctagaaatagcaagttaaaataaggctagtccgttatcaacttgaaaaagtggcaccgagtcggtgctcggcccttctca

SEQ ID NO: 34350 - DNA, 110 bp, synthetic construct
  source 1..110: mol_type = other DNA
gggtcgtagcgaactgagaagttttagagctagaaatagcaagttaaaataaggctagtccgttatcaacttgaaaaagtggcaccgagtcggtgcctcggcccttctca

SEQ ID NO: 34351 - DNA, 111 bp, synthetic construct
  source 1..111: mol_type = other DNA
gggtcgtagcgaactgagaagttttagagctagaaatagcaagttaaaataaggctagtccgttatcaacttgaaaaagtggcaccgagtcggtgccctcggcccttctca

SEQ ID NO: 34352 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgcacctcggcccttctca

SEQ ID NO: 34353 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgctacctcggcccttctca

SEQ ID NO: 34354 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgcatacctcggcccttctca

SEQ ID NO: 34355 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgcaatacctcggcccttctca

SEQ ID NO: 34356 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgccaatacctcggcccttctca

SEQ ID NO: 34357 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgcacaatacctcggcccttctca

SEQ ID NO: 34358 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgccacaatacctcggcccttctca

SEQ ID NO: 34359 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcccacaatacctcggcccttctca

SEQ ID NO: 34360 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcgccacaatacctcggcccttctca

SEQ ID NO: 34361 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgctgccacaatacctcggcccttctca

SEQ ID NO: 34362 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctca

SEQ ID NO: 34363 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctca

SEQ ID NO: 34364 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctca

SEQ ID NO: 34365 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctca

SEQ ID NO: 34366 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctca

SEQ ID NO: 34367 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctca

SEQ ID NO: 34368 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctca

SEQ ID NO: 34369 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctca

SEQ ID NO: 34370 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctca

SEQ ID NO: 34371 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctca

SEQ ID NO: 34372 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctca

SEQ ID NO: 34373 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctca

SEQ ID NO: 34374 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctca

SEQ ID NO: 34375 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctca

SEQ ID NO: 34376 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctca

SEQ ID NO: 34377 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctca

SEQ ID NO: 34378 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctca

SEQ ID NO: 34379 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctca

SEQ ID NO: 34380 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctca

SEQ ID NO: 34381 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctca

SEQ ID NO: 34382 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctca

SEQ ID NO: 34383 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctca

SEQ ID NO: 34384 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctca

SEQ ID NO: 34385 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctca

SEQ ID NO: 34386 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctca

SEQ ID NO: 34387 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctca

SEQ ID NO: 34388 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctca

SEQ ID NO: 34389 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctca

SEQ ID NO: 34390 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctca

SEQ ID NO: 34391 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctca

SEQ ID NO: 34392 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctca

SEQ ID NO: 34393 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctca

SEQ ID NO: 34394 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctca

SEQ ID NO: 34395 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctca

SEQ ID NO: 34396 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctca

SEQ ID NO: 34397 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctca

SEQ ID NO: 34398 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctca

SEQ ID NO: 34399 - DNA, 108 bp, synthetic construct
  source 1..108: mol_type = other DNA
gggtcgtagcgaactgagaagttttagagctagaaatagcaagttaaaataaggctagtccgttatcaacttgaaaaagtggcaccgagtcggtgccggcccttctca

SEQ ID NO: 34400 - DNA, 110 bp, synthetic construct
  source 1..110: mol_type = other DNA
gggtcgtagcgaactgagaagttttagagctagaaatagcaagttaaaataaggctagtccgttatcaacttgaaaaagtggcaccgagtcggtgctcggcccttctcag

SEQ ID NO: 34401 - DNA, 111 bp, synthetic construct
  source 1..111: mol_type = other DNA
gggtcgtagcgaactgagaagttttagagctagaaatagcaagttaaaataaggctagtccgttatcaacttgaaaaagtggcaccgagtcggtgcctcggcccttctcag

SEQ ID NO: 34402 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgccctcggcccttctcag

SEQ ID NO: 34403 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgcacctcggcccttctcag

SEQ ID NO: 34404 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgctacctcggcccttctcag

SEQ ID NO: 34405 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgcatacctcggcccttctcag

SEQ ID NO: 34406 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgcaatacctcggcccttctcag

SEQ ID NO: 34407 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgccaatacctcggcccttctcag

SEQ ID NO: 34408 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgcacaatacctcggcccttctcag

SEQ ID NO: 34409 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgccacaatacctcggcccttctcag

SEQ ID NO: 34410 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcccacaatacctcggcccttctcag

SEQ ID NO: 34411 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcag

SEQ ID NO: 34412 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcag

SEQ ID NO: 34413 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcag

SEQ ID NO: 34414 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcag

SEQ ID NO: 34415 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcag

SEQ ID NO: 34416 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcag

SEQ ID NO: 34417 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcag

SEQ ID NO: 34418 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcag

SEQ ID NO: 34419 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcag

SEQ ID NO: 34420 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcag

SEQ ID NO: 34421 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcag

SEQ ID NO: 34422 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcag

SEQ ID NO: 34423 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcag

SEQ ID NO: 34424 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcag

SEQ ID NO: 34425 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcag

SEQ ID NO: 34426 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcag

SEQ ID NO: 34427 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcag

SEQ ID NO: 34428 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcag

SEQ ID NO: 34429 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcag

SEQ ID NO: 34430 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcag

SEQ ID NO: 34431 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcag

SEQ ID NO: 34432 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcag

SEQ ID NO: 34433 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcag

SEQ ID NO: 34434 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcag

SEQ ID NO: 34435 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcag

SEQ ID NO: 34436 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcag

SEQ ID NO: 34437 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcag

SEQ ID NO: 34438 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcag

SEQ ID NO: 34439 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcag

SEQ ID NO: 34440 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcag

SEQ ID NO: 34441 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcag

SEQ ID NO: 34442 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcag

SEQ ID NO: 34443 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcag

SEQ ID NO: 34444 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcag

SEQ ID NO: 34445 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcag

SEQ ID NO: 34446 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcag

SEQ ID NO: 34447 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcag

SEQ ID NO: 34448 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcag

SEQ ID NO: 34449 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcag

SEQ ID NO: 34450 - DNA, 109 bp, synthetic construct
  source 1..109: mol_type = other DNA
gggtcgtagcgaactgagaagttttagagctagaaatagcaagttaaaataaggctagtccgttatcaacttgaaaaagtggcaccgagtcggtgccggcccttctcag

SEQ ID NO: 34451 - DNA, 111 bp, synthetic construct
  source 1..111: mol_type = other DNA
gggtcgtagcgaactgagaagttttagagctagaaatagcaagttaaaataaggctagtccgttatcaacttgaaaaagtggcaccgagtcggtgctcggcccttctcagt

SEQ ID NO: 34452 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgcctcggcccttctcagt

SEQ ID NO: 34453 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgccctcggcccttctcagt

SEQ ID NO: 34454 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgcacctcggcccttctcagt

SEQ ID NO: 34455 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgctacctcggcccttctcagt

SEQ ID NO: 34456 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgcatacctcggcccttctcagt

SEQ ID NO: 34457 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgcaatacctcggcccttctcagt

SEQ ID NO: 34458 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgccaatacctcggcccttctcagt

SEQ ID NO: 34459 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcacaatacctcggcccttctcagt

SEQ ID NO: 34460 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgccacaatacctcggcccttctcagt

SEQ ID NO: 34461 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagt

SEQ ID NO: 34462 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagt

SEQ ID NO: 34463 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagt

SEQ ID NO: 34464 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagt

SEQ ID NO: 34465 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagt

SEQ ID NO: 34466 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagt

SEQ ID NO: 34467 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagt

SEQ ID NO: 34468 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagt

SEQ ID NO: 34469 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagt

SEQ ID NO: 34470 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagt

SEQ ID NO: 34471 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagt

SEQ ID NO: 34472 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagt

SEQ ID NO: 34473 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagt

SEQ ID NO: 34474 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagt

SEQ ID NO: 34475 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagt

SEQ ID NO: 34476 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagt

SEQ ID NO: 34477 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagt

SEQ ID NO: 34478 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagt

SEQ ID NO: 34479 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagt

SEQ ID NO: 34480 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagt

SEQ ID NO: 34481 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagt

SEQ ID NO: 34482 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagt

SEQ ID NO: 34483 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagt

SEQ ID NO: 34484 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagt

SEQ ID NO: 34485 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagt

SEQ ID NO: 34486 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagt

SEQ ID NO: 34487 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagt

SEQ ID NO: 34488 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagt

SEQ ID NO: 34489 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagt

SEQ ID NO: 34490 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagt

SEQ ID NO: 34491 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagt

SEQ ID NO: 34492 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagt

SEQ ID NO: 34493 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagt

SEQ ID NO: 34494 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagt

SEQ ID NO: 34495 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagt

SEQ ID NO: 34496 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagt

SEQ ID NO: 34497 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagt

SEQ ID NO: 34498 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagt

SEQ ID NO: 34499 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagt

SEQ ID NO: 34500 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagt

SEQ ID NO: 34501 - DNA, 110 bp, synthetic construct
  source 1..110: mol_type = other DNA
gggtcgtagcgaactgagaagttttagagctagaaatagcaagttaaaataaggctagtccgttatcaacttgaaaaagtggcaccgagtcggtgccggcccttctcagt

SEQ ID NO: 34502 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgctcggcccttctcagtt

SEQ ID NO: 34503 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgcctcggcccttctcagtt

SEQ ID NO: 34504 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgccctcggcccttctcagtt

SEQ ID NO: 34505 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgcacctcggcccttctcagtt

SEQ ID NO: 34506 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgctacctcggcccttctcagtt

SEQ ID NO: 34507 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgcatacctcggcccttctcagtt

SEQ ID NO: 34508 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgcaatacctcggcccttctcagtt

SEQ ID NO: 34509 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgccaatacctcggcccttctcagtt

SEQ ID NO: 34510 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcacaatacctcggcccttctcagtt

SEQ ID NO: 34511 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgccacaatacctcggcccttctcagtt

SEQ ID NO: 34512 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagtt

SEQ ID NO: 34513 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagtt

SEQ ID NO: 34514 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagtt

SEQ ID NO: 34515 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagtt

SEQ ID NO: 34516 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagtt

SEQ ID NO: 34517 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagtt

SEQ ID NO: 34518 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagtt

SEQ ID NO: 34519 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagtt

SEQ ID NO: 34520 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagtt

SEQ ID NO: 34521 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagtt

SEQ ID NO: 34522 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagtt

SEQ ID NO: 34523 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagtt

SEQ ID NO: 34524 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagtt

SEQ ID NO: 34525 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagtt

SEQ ID NO: 34526 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagtt

SEQ ID NO: 34527 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagtt

SEQ ID NO: 34528 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagtt

SEQ ID NO: 34529 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagtt

SEQ ID NO: 34530 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagtt

SEQ ID NO: 34531 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagtt

SEQ ID NO: 34532 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagtt

SEQ ID NO: 34533 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagtt

SEQ ID NO: 34534 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagtt

SEQ ID NO: 34535 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagtt

SEQ ID NO: 34536 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagtt

SEQ ID NO: 34537 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagtt

SEQ ID NO: 34538 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagtt

SEQ ID NO: 34539 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagtt

SEQ ID NO: 34540 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagtt

SEQ ID NO: 34541 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagtt

SEQ ID NO: 34542 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagtt

SEQ ID NO: 34543 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagtt

SEQ ID NO: 34544 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagtt

SEQ ID NO: 34545 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagtt

SEQ ID NO: 34546 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagtt

SEQ ID NO: 34547 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagtt

SEQ ID NO: 34548 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagtt

SEQ ID NO: 34549 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagtt

SEQ ID NO: 34550 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagtt

SEQ ID NO: 34551 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagtt

SEQ ID NO: 34552 - DNA, 111 bp, synthetic construct
  source 1..111: mol_type = other DNA
gggtcgtagcgaactgagaagttttagagctagaaatagcaagttaaaataaggctagtccgttatcaacttgaaaaagtggcaccgagtcggtgccggcccttctcagtt

SEQ ID NO: 34553 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgctcggcccttctcagttc

SEQ ID NO: 34554 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgcctcggcccttctcagttc

SEQ ID NO: 34555 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgccctcggcccttctcagttc

SEQ ID NO: 34556 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgcacctcggcccttctcagttc

SEQ ID NO: 34557 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgctacctcggcccttctcagttc

SEQ ID NO: 34558 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgcatacctcggcccttctcagttc

SEQ ID NO: 34559 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcaatacctcggcccttctcagttc

SEQ ID NO: 34560 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgccaatacctcggcccttctcagttc

SEQ ID NO: 34561 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttc

SEQ ID NO: 34562 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttc

SEQ ID NO: 34563 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttc

SEQ ID NO: 34564 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttc

SEQ ID NO: 34565 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttc

SEQ ID NO: 34566 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttc

SEQ ID NO: 34567 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttc

SEQ ID NO: 34568 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttc

SEQ ID NO: 34569 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttc

SEQ ID NO: 34570 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttc

SEQ ID NO: 34571 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttc

SEQ ID NO: 34572 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttc

SEQ ID NO: 34573 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttc

SEQ ID NO: 34574 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttc

SEQ ID NO: 34575 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttc

SEQ ID NO: 34576 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttc

SEQ ID NO: 34577 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttc

SEQ ID NO: 34578 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttc

SEQ ID NO: 34579 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttc

SEQ ID NO: 34580 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttc

SEQ ID NO: 34581 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttc

SEQ ID NO: 34582 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttc

SEQ ID NO: 34583 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttc

SEQ ID NO: 34584 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttc

SEQ ID NO: 34585 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttc

SEQ ID NO: 34586 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttc

SEQ ID NO: 34587 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttc

SEQ ID NO: 34588 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttc

SEQ ID NO: 34589 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttc

SEQ ID NO: 34590 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttc

SEQ ID NO: 34591 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttc

SEQ ID NO: 34592 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttc

SEQ ID NO: 34593 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttc

SEQ ID NO: 34594 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttc

SEQ ID NO: 34595 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttc

SEQ ID NO: 34596 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttc

SEQ ID NO: 34597 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttc

SEQ ID NO: 34598 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttc

SEQ ID NO: 34599 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttc

SEQ ID NO: 34600 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttc

SEQ ID NO: 34601 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttc

SEQ ID NO: 34602 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttc

SEQ ID NO: 34603 - DNA, 112 bp, synthetic construct
  source 1..112: mol_type = other DNA
gggtcgtagcgaactgagaagttttagagctagaaatagcaagttaaaataaggctagtccgttatcaacttgaaaaagtggcaccgagtcggtgccggcccttctcagttc

SEQ ID NO: 34604 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgctcggcccttctcagttcg

SEQ ID NO: 34605 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgcctcggcccttctcagttcg

SEQ ID NO: 34606 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgccctcggcccttctcagttcg

SEQ ID NO: 34607 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgcacctcggcccttctcagttcg

SEQ ID NO: 34608 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgctacctcggcccttctcagttcg

SEQ ID NO: 34609 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgcatacctcggcccttctcagttcg

SEQ ID NO: 34610 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcg

SEQ ID NO: 34611 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcg

SEQ ID NO: 34612 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcg

SEQ ID NO: 34613 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcg

SEQ ID NO: 34614 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcg

SEQ ID NO: 34615 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcg

SEQ ID NO: 34616 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcg

SEQ ID NO: 34617 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcg

SEQ ID NO: 34618 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcg

SEQ ID NO: 34619 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcg

SEQ ID NO: 34620 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcg

SEQ ID NO: 34621 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcg

SEQ ID NO: 34622 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcg

SEQ ID NO: 34623 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcg

SEQ ID NO: 34624 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcg

SEQ ID NO: 34625 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcg

SEQ ID NO: 34626 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcg

SEQ ID NO: 34627 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcg

SEQ ID NO: 34628 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcg

SEQ ID NO: 34629 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcg

SEQ ID NO: 34630 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcg

SEQ ID NO: 34631 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcg

SEQ ID NO: 34632 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcg

SEQ ID NO: 34633 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcg

SEQ ID NO: 34634 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcg

SEQ ID NO: 34635 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcg

SEQ ID NO: 34636 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcg

SEQ ID NO: 34637 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcg

SEQ ID NO: 34638 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcg

SEQ ID NO: 34639 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcg

SEQ ID NO: 34640 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcg

SEQ ID NO: 34641 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcg

SEQ ID NO: 34642 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcg

SEQ ID NO: 34643 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcg

SEQ ID NO: 34644 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcg

SEQ ID NO: 34645 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcg

SEQ ID NO: 34646 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcg

SEQ ID NO: 34647 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcg

SEQ ID NO: 34648 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcg

SEQ ID NO: 34649 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcg

SEQ ID NO: 34650 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcg

SEQ ID NO: 34651 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcg

SEQ ID NO: 34652 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcg

SEQ ID NO: 34653 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcg

SEQ ID NO: 34654 - DNA, 113 bp, synthetic construct
  source 1..113: mol_type = other DNA
gggtcgtagcgaactgagaagttttagagctagaaatagcaagttaaaataaggctagtccgttatcaacttgaaaaagtggcaccgagtcggtgccggcccttctcagttcg

SEQ ID NO: 34655 - DNA, 115 bp, synthetic construct
  source 1..115: mol_type = other DNA
gggtcgtagcgaactgagaagttttagagctagaaatagcaagttaaaataaggctagtccgttatcaacttgaaaaagtggcaccgagtcggtgctcggcccttctcagttcgc

SEQ ID NO: 34656 - DNA, 116 bp, synthetic construct
  source 1..116: mol_type = other DNA
gggtcgtagcgaactgagaagttttagagctagaaatagcaagttaaaataaggctagtccgttatcaacttgaaaaagtggcaccgagtcggtgcctcggcccttctcagttcgc

SEQ ID NO: 34657 - DNA, 117 bp, synthetic construct
  source 1..117: mol_type = other DNA
gggtcgtagcgaactgagaagttttagagctagaaatagcaagttaaaataaggctagtccgttatcaacttgaaaaagtggcaccgagtcggtgccctcggcccttctcagttcgc

SEQ ID NO: 34658 - DNA, 118 bp, synthetic construct
  source 1..118: mol_type = other DNA
gggtcgtagcgaactgagaagttttagagctagaaatagcaagttaaaataaggctagtccgttatcaacttgaaaaagtggcaccgagtcggtgcacctcggcccttctcagttcgc

SEQ ID NO: 34659 - DNA, 119 bp, synthetic construct
  source 1..119: mol_type = other DNA
gggtcgtagcgaactgagaagttttagagctagaaatagcaagttaaaataaggctagtccgttatcaacttgaaaaagtggcaccgagtcggtgctacctcggcccttctcagttcgc

SEQ ID NO: 34660 - DNA, 120 bp, synthetic construct
  source 1..120: mol_type = other DNA
gggtcgtagcgaactgagaagttttagagctagaaatagcaagttaaaataaggctagtccgttatcaacttgaaaaagtggcaccgagtcggtgcatacctcggcccttctcagttcgc

SEQ ID NO: 34661 - DNA, 121 bp, synthetic construct
  source 1..121: mol_type = other DNA
gggtcgtagcgaactgagaagttttagagctagaaatagcaagttaaaataaggctagtccgttatcaacttgaaaaagtggcaccgagtcggtgcaatacctcggcccttctcagttcgc

SEQ ID NO: 34662 - DNA, 122 bp, synthetic construct
  source 1..122: mol_type = other DNA
gggtcgtagcgaactgagaagttttagagctagaaatagcaagttaaaataaggctagtccgttatcaacttgaaaaagtggcaccgagtcggtgccaatacctcggcccttctcagttcgc

SEQ ID NO: 34663 - DNA, 123 bp, synthetic construct
  source 1..123: mol_type = other DNA
gggtcgtagcgaactgagaagttttagagctagaaatagcaagttaaaataaggctagtccgttatcaacttgaaaaagtggcaccgagtcggtgcacaatacctcggcccttctcagttcgc

SEQ ID NO: 34664 - DNA, 124 bp, synthetic construct
  source 1..124: mol_type = other DNA
gggtcgtagcgaactgagaagttttagagctagaaatagcaagttaaaataaggctagtccgttatcaacttgaaaaagtggcaccgagtcggtgccacaatacctcggcccttctcagttcgc

SEQ ID NO: 34665 - DNA, 125 bp, synthetic construct
  source 1..125: mol_type = other DNA
gggtcgtagcgaactgagaagttttagagctagaaatagcaagttaaaataaggctagtccgttatcaacttgaaaaagtggcaccgagtcggtgcccacaatacctcggcccttctcagttcgc

SEQ ID NO: 34666 - DNA, 126 bp, synthetic construct
  source 1..126: mol_type = other DNA
gggtcgtagcgaactgagaagttttagagctagaaatagcaagttaaaataaggctagtccgttatcaacttgaaaaagtggcaccgagtcggtgcgccacaatacctcggcccttctcagttcgc

SEQ ID NO: 34667 - DNA, 127 bp, synthetic construct
  source 1..127: mol_type = other DNA
gggtcgtagcgaactgagaagttttagagctagaaatagcaagttaaaataaggctagtccgttatcaacttgaaaaagtggcaccgagtcggtgctgccacaatacctcggcccttctcagttcgc

SEQ ID NO: 34668 - DNA, 128 bp, synthetic construct
  source 1..128: mol_type = other DNA
gggtcgtagcgaactgagaagttttagagctagaaatagcaagttaaaataaggctagtccgttatcaacttgaaaaagtggcaccgagtcggtgcctgccacaatacctcggcccttctcagttcgc

SEQ ID NO: 34669 - DNA, 129 bp, synthetic construct
  source 1..129: mol_type = other DNA
gggtcgtagcgaactgagaagttttagagctagaaatagcaagttaaaataaggctagtccgttatcaacttgaaaaagtggcaccgagtcggtgcgctgccacaatacctcggcccttctcagttcgc

SEQ ID NO: 34670 - DNA, 130 bp, synthetic construct
  source 1..130: mol_type = other DNA
gggtcgtagcgaactgagaagttttagagctagaaatagcaagttaaaataaggctagtccgttatcaacttgaaaaagtggcaccgagtcggtgctgctgccacaatacctcggcccttctcagttcgc

SEQ ID NO: 34671 - DNA, 131 bp, synthetic construct
  source 1..131: mol_type = other DNA
gggtcgtagcgaactgagaagttttagagctagaaatagcaagttaaaataaggctagtccgttatcaacttgaaaaagtggcaccgagtcggtgcttgctgccacaatacctcggcccttctcagttcgc

SEQ ID NO: 34672 - DNA, 132 bp, synthetic construct
  source 1..132: mol_type = other DNA
gggtcgtagcgaactgagaagttttagagctagaaatagcaagttaaaataaggctagtccgttatcaacttgaaaaagtggcaccgagtcggtgctttgctgccacaatacctcggcccttctcagttcgc

SEQ ID NO: 34673 - DNA, 133 bp, synthetic construct
  source 1..133: mol_type = other DNA
gggtcgtagcgaactgagaagttttagagctagaaatagcaagttaaaataaggctagtccgttatcaacttgaaaaagtggcaccgagtcggtgcctttgctgccacaatacctcggcccttctcagttcgc

SEQ ID NO: 34674 - DNA, 134 bp, synthetic construct
  source 1..134: mol_type = other DNA
gggtcgtagcgaactgagaagttttagagctagaaatagcaagttaaaataaggctagtccgttatcaacttgaaaaagtggcaccgagtcggtgcactttgctgccacaatacctcggcccttctcagttcgc

SEQ ID NO: 34675 - DNA, 135 bp, synthetic construct
  source 1..135: mol_type = other DNA
gggtcgtagcgaactgagaagttttagagctagaaatagcaagttaaaataaggctagtccgttatcaacttgaaaaagtggcaccgagtcggtgcaactttgctgccacaatacctcggcccttctcagttcgc

SEQ ID NO: 34676 - DNA, 136 bp, synthetic construct
  source 1..136: mol_type = other DNA
gggtcgtagcgaactgagaagttttagagctagaaatagcaagttaaaataaggctagtccgttatcaacttgaaaaagtggcaccgagtcggtgcgaactttgctgccacaatacctcggcccttctcagttcgc

SEQ ID NO: 34677 - DNA, 137 bp, synthetic construct
  source 1..137: mol_type = other DNA
gggtcgtagcgaactgagaagttttagagctagaaatagcaagttaaaataaggctagtccgttatcaacttgaaaaagtggcaccgagtcggtgcggaactttgctgccacaatacctcggcccttctcagttcgc

SEQ ID NO: 34678 - DNA, 138 bp, synthetic construct
  source 1..138: mol_type = other DNA
gggtcgtagcgaactgagaagttttagagctagaaatagcaagttaaaataaggctagtccgttatcaacttgaaaaagtggcaccgagtcggtgcaggaactttgctgccacaatacctcggcccttctcagttcgc

SEQ ID NO: 34679 - DNA, 139 bp, synthetic construct
  source 1..139: mol_type = other DNA
gggtcgtagcgaactgagaagttttagagctagaaatagcaagttaaaataaggctagtccgttatcaacttgaaaaagtggcaccgagtcggtgctaggaactttgctgccacaatacctcggcccttctcagttcgc

SEQ ID NO: 34680 - DNA, 140 bp, synthetic construct
  source 1..140: mol_type = other DNA
gggtcgtagcgaactgagaagttttagagctagaaatagcaagttaaaataaggctagtccgttatcaacttgaaaaagtggcaccgagtcggtgcttaggaactttgctgccacaatacctcggcccttctcagttcgc

SEQ ID NO: 34681 - DNA, 141 bp, synthetic construct
  source 1..141: mol_type = other DNA
gggtcgtagcgaactgagaagttttagagctagaaatagcaagttaaaataaggctagtccgttatcaacttgaaaaagtggcaccgagtcggtgccttaggaactttgctgccacaatacctcggcccttctcagttcgc

SEQ ID NO: 34682 - DNA, 142 bp, synthetic construct
  source 1..142: mol_type = other DNA
gggtcgtagcgaactgagaagttttagagctagaaatagcaagttaaaataaggctagtccgttatcaacttgaaaaagtggcaccgagtcggtgctcttaggaactttgctgccacaatacctcggcccttctcagttcgc

SEQ ID NO: 34683 - DNA, 143 bp, synthetic construct
  source 1..143: mol_type = other DNA
gggtcgtagcgaactgagaagttttagagctagaaatagcaagttaaaataaggctagtccgttatcaacttgaaaaagtggcaccgagtcggtgcgtcttaggaactttgctgccacaatacctcggcccttctcagttcgc

SEQ ID NO: 34684 - DNA, 144 bp, synthetic construct
  source 1..144: mol_type = other DNA
gggtcgtagcgaactgagaagttttagagctagaaatagcaagttaaaataaggctagtccgttatcaacttgaaaaagtggcaccgagtcggtgcggtcttaggaactttgctgccacaatacctcggcccttctcagttcgc

SEQ ID NO: 34685 - DNA, 145 bp, synthetic construct
  source 1..145: mol_type = other DNA
gggtcgtagcgaactgagaagttttagagctagaaatagcaagttaaaataaggctagtccgttatcaacttgaaaaagtggcaccgagtcggtgctggtcttaggaactttgctgccacaatacctcggcccttctcagttcgc

SEQ ID NO: 34686 - DNA, 146 bp, synthetic construct
  source 1..146: mol_type = other DNA
gggtcgtagcgaactgagaagttttagagctagaaatagcaagttaaaataaggctagtccgttatcaacttgaaaaagtggcaccgagtcggtgcttggtcttaggaactttgctgccacaatacctcggcccttctcagttcgc

SEQ ID NO: 34687 - DNA, 147 bp, synthetic construct
  source 1..147: mol_type = other DNA
gggtcgtagcgaactgagaagttttagagctagaaatagcaagttaaaataaggctagtccgttatcaacttgaaaaagtggcaccgagtcggtgctttggtcttaggaactttgctgccacaatacctcggcccttctcagttcgc

SEQ ID NO: 34688 - DNA, 148 bp, synthetic construct
  source 1..148: mol_type = other DNA
gggtcgtagcgaactgagaagttttagagctagaaatagcaagttaaaataaggctagtccgttatcaacttgaaaaagtggcaccgagtcggtgcttttggtcttaggaactttgctgccacaatacctcggcccttctcagttcgc

SEQ ID NO: 34689 - DNA, 149 bp, synthetic construct
  source 1..149: mol_type = other DNA
gggtcgtagcgaactgagaagttttagagctagaaatagcaagttaaaataaggctagtccgttatcaacttgaaaaagtggcaccgagtcggtgcgttttggtcttaggaactttgctgccacaatacctcggcccttctcagttcgc

SEQ ID NO: 34690 - DNA, 150 bp, synthetic construct
  source 1..150: mol_type = other DNA
gggtcgtagcgaactgagaagttttagagctagaaatagcaagttaaaataaggctagtccgttatcaacttgaaaaagtggcaccgagtcggtgcggttttggtcttaggaactttgctgccacaatacctcggcccttctcagttcgc

SEQ ID NO: 34691 - DNA, 151 bp, synthetic construct
  source 1..151: mol_type = other DNA
gggtcgtagcgaactgagaagttttagagctagaaatagcaagttaaaataaggctagtccgttatcaacttgaaaaagtggcaccgagtcggtgctggttttggtcttaggaactttgctgccacaatacctcggcccttctcagttcgc

SEQ ID NO: 34692 - DNA, 152 bp, synthetic construct
  source 1..152: mol_type = other DNA
gggtcgtagcgaactgagaagttttagagctagaaatagcaagttaaaataaggctagtccgttatcaacttgaaaaagtggcaccgagtcggtgcgtggttttggtcttaggaactttgctgccacaatacctcggcccttctcagttcgc

SEQ ID NO: 34693 - DNA, 153 bp, synthetic construct
  source 1..153: mol_type = other DNA
gggtcgtagcgaactgagaagttttagagctagaaatagcaagttaaaataaggctagtccgttatcaacttgaaaaagtggcaccgagtcggtgctgtggttttggtcttaggaactttgctgccacaatacctcggcccttctcagttcgc

SEQ ID NO: 34694 - DNA, 154 bp, synthetic construct
  source 1..154: mol_type = other DNA
gggtcgtagcgaactgagaagttttagagctagaaatagcaagttaaaataaggctagtccgttatcaacttgaaaaagtggcaccgagtcggtgcctgtggttttggtcttaggaactttgctgccacaatacctcggcccttctcagttcgc

SEQ ID NO: 34695 - DNA, 155 bp, synthetic construct
  source 1..155: mol_type = other DNA
gggtcgtagcgaactgagaagttttagagctagaaatagcaagttaaaataaggctagtccgttatcaacttgaaaaagtggcaccgagtcggtgccctgtggttttggtcttaggaactttgctgccacaatacctcggcccttctcagttcgc

SEQ ID NO: 34696 - DNA, 156 bp, synthetic construct
  source 1..156: mol_type = other DNA
gggtcgtagcgaactgagaagttttagagctagaaatagcaagttaaaataaggctagtccgttatcaacttgaaaaagtggcaccgagtcggtgcgcctgtggttttggtcttaggaactttgctgccacaatacctcggcccttctcagttcgc

SEQ ID NO: 34697 - DNA, 157 bp, synthetic construct
  source 1..157: mol_type = other DNA
gggtcgtagcgaactgagaagttttagagctagaaatagcaagttaaaataaggctagtccgttatcaacttgaaaaagtggcaccgagtcggtgcagcctgtggttttggtcttaggaactttgctgccacaatacctcggcccttctcagttcgc

SEQ ID NO: 34698 - DNA, 158 bp, synthetic construct
  source 1..158: mol_type = other DNA
gggtcgtagcgaactgagaagttttagagctagaaatagcaagttaaaataaggctagtccgttatcaacttgaaaaagtggcaccgagtcggtgcaagcctgtggttttggtcttaggaactttgctgccacaatacctcggcccttctcagttcgc

SEQ ID NO: 34699 - DNA, 159 bp, synthetic construct
  source 1..159: mol_type = other DNA
gggtcgtagcgaactgagaagttttagagctagaaatagcaagttaaaataaggctagtccgttatcaacttgaaaaagtggcaccgagtcggtgccaagcctgtggttttggtcttaggaactttgctgccacaatacctcggcccttctcagttcgc

SEQ ID NO: 34700 - DNA, 160 bp, synthetic construct
  source 1..160: mol_type = other DNA
gggtcgtagcgaactgagaagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgc

SEQ ID NO: 34701 - DNA, 161 bp, synthetic construct
  source 1..161: mol_type = other DNA
gggtcgtagcgaactgagaagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgc

SEQ ID NO: 34702 - DNA, 162 bp, synthetic construct
  source 1..162: mol_type = other DNA
gggtcgtagcgaactgagaagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgc

SEQ ID NO: 34703 - DNA, 163 bp, synthetic construct
  source 1..163: mol_type = other DNA
gggtcgtagcgaactgagaagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgc

SEQ ID NO: 34704 - DNA, 164 bp, synthetic construct
  source 1..164: mol_type = other DNA
gggtcgtagcgaactgagaagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgc

SEQ ID NO: 34705 - DNA, 114 bp, synthetic construct
  source 1..114: mol_type = other DNA
gggtcgtagcgaactgagaagttttagagctagaaatagcaagttaaaataaggctagtccgttatcaacttgaaaaagtggcaccgagtcggtgccggcccttctcagttcgc

SEQ ID NO: 34706 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgcaatacctcgg

SEQ ID NO: 34707 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgccaatacctcgg

SEQ ID NO: 34708 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgcacaatacctcgg

SEQ ID NO: 34709 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgccacaatacctcgg

SEQ ID NO: 34710 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgcccacaatacctcgg

SEQ ID NO: 34711 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgcgccacaatacctcgg

SEQ ID NO: 34712 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgctgccacaatacctcgg

SEQ ID NO: 34713 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcctgccacaatacctcgg

SEQ ID NO: 34714 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcgctgccacaatacctcgg

SEQ ID NO: 34715 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgctgctgccacaatacctcgg

SEQ ID NO: 34716 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcttgctgccacaatacctcgg

SEQ ID NO: 34717 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgctttgctgccacaatacctcgg

SEQ ID NO: 34718 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcctttgctgccacaatacctcgg

SEQ ID NO: 34719 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcactttgctgccacaatacctcgg

SEQ ID NO: 34720 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcaactttgctgccacaatacctcgg

SEQ ID NO: 34721 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcgaactttgctgccacaatacctcgg

SEQ ID NO: 34722 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcggaactttgctgccacaatacctcgg

SEQ ID NO: 34723 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcaggaactttgctgccacaatacctcgg

SEQ ID NO: 34724 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgctaggaactttgctgccacaatacctcgg

SEQ ID NO: 34725 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcgg

SEQ ID NO: 34726 - DNA, 99 bp, synthetic construct
  source 1..99: mol_type = other DNA
tagcgaactgagaagggccagttttagagctagaaatagcaagttaaaataaggctagtccgttatcaacttgaaaaagtggcaccgagtcggtgccgg

SEQ ID NO: 34727 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcgg

SEQ ID NO: 34728 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcgg

SEQ ID NO: 34729 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcgg

SEQ ID NO: 34730 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcgg

SEQ ID NO: 34731 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcgg

SEQ ID NO: 34732 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcgg

SEQ ID NO: 34733 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcgg

SEQ ID NO: 34734 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcgg

SEQ ID NO: 34735 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcgg

SEQ ID NO: 34736 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcgg

SEQ ID NO: 34737 - DNA, 100 bp, synthetic construct
  source 1..100: mol_type = other DNA
tagcgaactgagaagggccagttttagagctagaaatagcaagttaaaataaggctagtccgttatcaacttgaaaaagtggcaccgagtcggtgctcgg

SEQ ID NO: 34738 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcgg

SEQ ID NO: 34739 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcgg

SEQ ID NO: 34740 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcgg

SEQ ID NO: 34741 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcgg

SEQ ID NO: 34742 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcgg

SEQ ID NO: 34743 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcgg

SEQ ID NO: 34744 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcgg

SEQ ID NO: 34745 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcgg

SEQ ID NO: 34746 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcgg

SEQ ID NO: 34747 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcgg

SEQ ID NO: 34748 - DNA, 101 bp, synthetic construct
  source 1..101: mol_type = other DNA
tagcgaactgagaagggccagttttagagctagaaatagcaagttaaaataaggctagtccgttatcaacttgaaaaagtggcaccgagtcggtgcctcgg

SEQ ID NO: 34749 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcgg

SEQ ID NO: 34750 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcgg

SEQ ID NO: 34751 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcgg

SEQ ID NO: 34752 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcgg

SEQ ID NO: 34753 - DNA, 102 bp, synthetic construct
  source 1..102: mol_type = other DNA
tagcgaactgagaagggccagttttagagctagaaatagcaagttaaaataaggctagtccgttatcaacttgaaaaagtggcaccgagtcggtgccctcgg

SEQ ID NO: 34754 - DNA, 103 bp, synthetic construct
  source 1..103: mol_type = other DNA
tagcgaactgagaagggccagttttagagctagaaatagcaagttaaaataaggctagtccgttatcaacttgaaaaagtggcaccgagtcggtgcacctcgg

SEQ ID NO: 34755 - DNA, 104 bp, synthetic construct
  source 1..104: mol_type = other DNA
tagcgaactgagaagggccagttttagagctagaaatagcaagttaaaataaggctagtccgttatcaacttgaaaaagtggcaccgagtcggtgctacctcgg

SEQ ID NO: 34756 - DNA, 105 bp, synthetic construct
  source 1..105: mol_type = other DNA
tagcgaactgagaagggccagttttagagctagaaatagcaagttaaaataaggctagtccgttatcaacttgaaaaagtggcaccgagtcggtgcatacctcgg

SEQ ID NO: 34757 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcaatacctcggcccttctcag

SEQ ID NO: 34758 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgccaatacctcggcccttctcag

SEQ ID NO: 34759 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacaatacctcggcccttctcag

SEQ ID NO: 34760 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgccacaatacctcggcccttctcag

SEQ ID NO: 34761 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcccacaatacctcggcccttctcag

SEQ ID NO: 34762 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcgccacaatacctcggcccttctcag

SEQ ID NO: 34763 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgccacaatacctcggcccttctcag

SEQ ID NO: 34764 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcctgccacaatacctcggcccttctcag

SEQ ID NO: 34765 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcag

SEQ ID NO: 34766 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcag

SEQ ID NO: 34767 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcag

SEQ ID NO: 34768 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcag

SEQ ID NO: 34769 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcag

SEQ ID NO: 34770 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcag

SEQ ID NO: 34771 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcag

SEQ ID NO: 34772 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcag

SEQ ID NO: 34773 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcag

SEQ ID NO: 34774 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcag

SEQ ID NO: 34775 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcag

SEQ ID NO: 34776 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcag

SEQ ID NO: 34777 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgccggcccttctcag

SEQ ID NO: 34778 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcag

SEQ ID NO: 34779 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcag

SEQ ID NO: 34780 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcag

SEQ ID NO: 34781 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcag

SEQ ID NO: 34782 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcag

SEQ ID NO: 34783 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcag

SEQ ID NO: 34784 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcag

SEQ ID NO: 34785 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcag

SEQ ID NO: 34786 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcag

SEQ ID NO: 34787 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcag

SEQ ID NO: 34788 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgctcggcccttctcag

SEQ ID NO: 34789 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcag

SEQ ID NO: 34790 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcag

SEQ ID NO: 34791 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcag

SEQ ID NO: 34792 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcag

SEQ ID NO: 34793 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcag

SEQ ID NO: 34794 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcag

SEQ ID NO: 34795 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcag

SEQ ID NO: 34796 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcag

SEQ ID NO: 34797 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcag

SEQ ID NO: 34798 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcag

SEQ ID NO: 34799 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgcctcggcccttctcag

SEQ ID NO: 34800 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcag

SEQ ID NO: 34801 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcag

SEQ ID NO: 34802 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcag

SEQ ID NO: 34803 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcag

SEQ ID NO: 34804 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgccctcggcccttctcag

SEQ ID NO: 34805 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcacctcggcccttctcag

SEQ ID NO: 34806 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgctacctcggcccttctcag

SEQ ID NO: 34807 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcatacctcggcccttctcag

SEQ ID NO: 34808 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcaatacctcggcccttctcagt

SEQ ID NO: 34809 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgccaatacctcggcccttctcagt

SEQ ID NO: 34810 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcacaatacctcggcccttctcagt

SEQ ID NO: 34811 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgccacaatacctcggcccttctcagt

SEQ ID NO: 34812 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcccacaatacctcggcccttctcagt

SEQ ID NO: 34813 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgccacaatacctcggcccttctcagt

SEQ ID NO: 34814 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgctgccacaatacctcggcccttctcagt

SEQ ID NO: 34815 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcctgccacaatacctcggcccttctcagt

SEQ ID NO: 34816 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcagt

SEQ ID NO: 34817 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcagt

SEQ ID NO: 34818 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcagt

SEQ ID NO: 34819 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcagt

SEQ ID NO: 34820 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcagt

SEQ ID NO: 34821 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcagt

SEQ ID NO: 34822 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcagt

SEQ ID NO: 34823 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcagt

SEQ ID NO: 34824 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcagt

SEQ ID NO: 34825 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcagt

SEQ ID NO: 34826 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcagt

SEQ ID NO: 34827 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcagt

SEQ ID NO: 34828 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgccggcccttctcagt

SEQ ID NO: 34829 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcagt

SEQ ID NO: 34830 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcagt

SEQ ID NO: 34831 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcagt

SEQ ID NO: 34832 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcagt

SEQ ID NO: 34833 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcagt

SEQ ID NO: 34834 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcagt

SEQ ID NO: 34835 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcagt

SEQ ID NO: 34836 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcagt

SEQ ID NO: 34837 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcagt

SEQ ID NO: 34838 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcagt

SEQ ID NO: 34839 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgctcggcccttctcagt

SEQ ID NO: 34840 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcagt

SEQ ID NO: 34841 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcagt

SEQ ID NO: 34842 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcagt

SEQ ID NO: 34843 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcagt

SEQ ID NO: 34844 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcagt

SEQ ID NO: 34845 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcagt

SEQ ID NO: 34846 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcagt

SEQ ID NO: 34847 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcagt

SEQ ID NO: 34848 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcagt

SEQ ID NO: 34849 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcagt

SEQ ID NO: 34850 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgcctcggcccttctcagt

SEQ ID NO: 34851 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcagt

SEQ ID NO: 34852 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcagt

SEQ ID NO: 34853 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcagt

SEQ ID NO: 34854 - DNA, 160 bp, synthetic construct
  source 1..160: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcagt

SEQ ID NO: 34855 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgccctcggcccttctcagt

SEQ ID NO: 34856 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcacctcggcccttctcagt

SEQ ID NO: 34857 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgctacctcggcccttctcagt

SEQ ID NO: 34858 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcatacctcggcccttctcagt

SEQ ID NO: 34859 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcaatacctcggcccttctcagtt

SEQ ID NO: 34860 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgccaatacctcggcccttctcagtt

SEQ ID NO: 34861 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcacaatacctcggcccttctcagtt

SEQ ID NO: 34862 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgccacaatacctcggcccttctcagtt

SEQ ID NO: 34863 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcccacaatacctcggcccttctcagtt

SEQ ID NO: 34864 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgccacaatacctcggcccttctcagtt

SEQ ID NO: 34865 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgctgccacaatacctcggcccttctcagtt

SEQ ID NO: 34866 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcctgccacaatacctcggcccttctcagtt

SEQ ID NO: 34867 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcagtt

SEQ ID NO: 34868 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcagtt

SEQ ID NO: 34869 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcagtt

SEQ ID NO: 34870 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcagtt

SEQ ID NO: 34871 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcagtt

SEQ ID NO: 34872 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcagtt

SEQ ID NO: 34873 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcagtt

SEQ ID NO: 34874 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcagtt

SEQ ID NO: 34875 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcagtt

SEQ ID NO: 34876 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcagtt

SEQ ID NO: 34877 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcagtt

SEQ ID NO: 34878 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcagtt

SEQ ID NO: 34879 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgccggcccttctcagtt

SEQ ID NO: 34880 - DNA, 138 bp, synthetic construct; identical to SEQ ID NO: 29024
  source 1..138: mol_type = other DNA

SEQ ID NO: 34881 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcagtt

SEQ ID NO: 34882 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcagtt

SEQ ID NO: 34883 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcagtt

SEQ ID NO: 34884 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcagtt

SEQ ID NO: 34885 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcagtt

SEQ ID NO: 34886 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcagtt

SEQ ID NO: 34887 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcagtt

SEQ ID NO: 34888 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcagtt

SEQ ID NO: 34889 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcagtt

SEQ ID NO: 34890 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgctcggcccttctcagtt

SEQ ID NO: 34891 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcagtt

SEQ ID NO: 34892 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcagtt

SEQ ID NO: 34893 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcagtt

SEQ ID NO: 34894 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcagtt

SEQ ID NO: 34895 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcagtt

SEQ ID NO: 34896 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcagtt

SEQ ID NO: 34897 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcagtt

SEQ ID NO: 34898 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcagtt

SEQ ID NO: 34899 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcagtt

SEQ ID NO: 34900 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcagtt

SEQ ID NO: 34901 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcctcggcccttctcagtt

SEQ ID NO: 34902 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcagtt

SEQ ID NO: 34903 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcagtt

SEQ ID NO: 34904 - DNA, 160 bp, synthetic construct
  source 1..160: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcagtt

SEQ ID NO: 34905 - DNA, 161 bp, synthetic construct
  source 1..161: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcagtt

SEQ ID NO: 34906 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgccctcggcccttctcagtt

SEQ ID NO: 34907 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcacctcggcccttctcagtt

SEQ ID NO: 34908 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgctacctcggcccttctcagtt

SEQ ID NO: 34909 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcatacctcggcccttctcagtt

SEQ ID NO: 34910 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcaatacctcggcccttctcagttc

SEQ ID NO: 34911 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgccaatacctcggcccttctcagttc

SEQ ID NO: 34912 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcacaatacctcggcccttctcagttc

SEQ ID NO: 34913 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgccacaatacctcggcccttctcagttc

SEQ ID NO: 34914 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcccacaatacctcggcccttctcagttc

SEQ ID NO: 34915 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgccacaatacctcggcccttctcagttc

SEQ ID NO: 34916 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgctgccacaatacctcggcccttctcagttc

SEQ ID NO: 34917 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcctgccacaatacctcggcccttctcagttc

SEQ ID NO: 34918 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcagttc

SEQ ID NO: 34919 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcagttc

SEQ ID NO: 34920 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcagttc

SEQ ID NO: 34921 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcagttc

SEQ ID NO: 34922 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcagttc

SEQ ID NO: 34923 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcagttc

SEQ ID NO: 34924 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcagttc

SEQ ID NO: 34925 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcagttc

SEQ ID NO: 34926 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcagttc

SEQ ID NO: 34927 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcagttc

SEQ ID NO: 34928 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcagttc

SEQ ID NO: 34929 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcagttc

SEQ ID NO: 34930 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgccggcccttctcagttc

SEQ ID NO: 34931 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcagttc

SEQ ID NO: 34932 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcagttc

SEQ ID NO: 34933 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcagttc

SEQ ID NO: 34934 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcagttc

SEQ ID NO: 34935 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcagttc

SEQ ID NO: 34936 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcagttc

SEQ ID NO: 34937 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcagttc

SEQ ID NO: 34938 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcagttc

SEQ ID NO: 34939 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcagttc

SEQ ID NO: 34940 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcagttc

SEQ ID NO: 34941 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgctcggcccttctcagttc

SEQ ID NO: 34942 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcagttc

SEQ ID NO: 34943 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcagttc

SEQ ID NO: 34944 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcagttc

SEQ ID NO: 34945 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcagttc

SEQ ID NO: 34946 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcagttc

SEQ ID NO: 34947 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcagttc

SEQ ID NO: 34948 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcagttc

SEQ ID NO: 34949 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcagttc

SEQ ID NO: 34950 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcagttc

SEQ ID NO: 34951 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcagttc

SEQ ID NO: 34952 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcctcggcccttctcagttc

SEQ ID NO: 34953 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcagttc

SEQ ID NO: 34954 - DNA, 160 bp, synthetic construct
  source 1..160: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcagttc

SEQ ID NO: 34955 - DNA, 161 bp, synthetic construct
  source 1..161: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcagttc

SEQ ID NO: 34956 - DNA, 162 bp, synthetic construct
  source 1..162: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttc

SEQ ID NO: 34957 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgccctcggcccttctcagttc

SEQ ID NO: 34958 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcacctcggcccttctcagttc

SEQ ID NO: 34959 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgctacctcggcccttctcagttc

SEQ ID NO: 34960 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcatacctcggcccttctcagttc

SEQ ID NO: 34961 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcaatacctcggcccttctcagttcg

SEQ ID NO: 34962 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgccaatacctcggcccttctcagttcg

SEQ ID NO: 34963 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcacaatacctcggcccttctcagttcg

SEQ ID NO: 34964 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgccacaatacctcggcccttctcagttcg

SEQ ID NO: 34965 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcccacaatacctcggcccttctcagttcg

SEQ ID NO: 34966 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcgccacaatacctcggcccttctcagttcg

SEQ ID NO: 34967 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgctgccacaatacctcggcccttctcagttcg

SEQ ID NO: 34968 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcctgccacaatacctcggcccttctcagttcg

SEQ ID NO: 34969 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcagttcg

SEQ ID NO: 34970 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcagttcg

SEQ ID NO: 34971 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcagttcg

SEQ ID NO: 34972 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcagttcg

SEQ ID NO: 34973 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcagttcg

SEQ ID NO: 34974 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcagttcg

SEQ ID NO: 34975 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcagttcg

SEQ ID NO: 34976 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcagttcg

SEQ ID NO: 34977 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcagttcg

SEQ ID NO: 34978 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcagttcg

SEQ ID NO: 34979 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcagttcg

SEQ ID NO: 34980 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcagttcg

SEQ ID NO: 34981 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgccggcccttctcagttcg

SEQ ID NO: 34982 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcagttcg

SEQ ID NO: 34983 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcagttcg

SEQ ID NO: 34984 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcagttcg

SEQ ID NO: 34985 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcagttcg

SEQ ID NO: 34986 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcagttcg

SEQ ID NO: 34987 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcagttcg

SEQ ID NO: 34988 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcagttcg

SEQ ID NO: 34989 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcagttcg

SEQ ID NO: 34990 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcagttcg

SEQ ID NO: 34991 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcagttcg

SEQ ID NO: 34992 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgctcggcccttctcagttcg

SEQ ID NO: 34993 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcagttcg

SEQ ID NO: 34994 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcagttcg

SEQ ID NO: 34995 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcagttcg

SEQ ID NO: 34996 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcagttcg

SEQ ID NO: 34997 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcagttcg

SEQ ID NO: 34998 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcagttcg

SEQ ID NO: 34999 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcagttcg

SEQ ID NO: 35000 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcagttcg

SEQ ID NO: 35001 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcagttcg

SEQ ID NO: 35002 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcagttcg

SEQ ID NO: 35003 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcctcggcccttctcagttcg

SEQ ID NO: 35004 - DNA, 160 bp, synthetic construct
  source 1..160: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcg

SEQ ID NO: 35005 - DNA, 161 bp, synthetic construct
  source 1..161: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcg

SEQ ID NO: 35006 - DNA, 162 bp, synthetic construct
  source 1..162: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcg

SEQ ID NO: 35007 - DNA, 163 bp, synthetic construct
  source 1..163: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcg

SEQ ID NO: 35008 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgccctcggcccttctcagttcg

SEQ ID NO: 35009 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcacctcggcccttctcagttcg

SEQ ID NO: 35010 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgctacctcggcccttctcagttcg

SEQ ID NO: 35011 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcatacctcggcccttctcagttcg

SEQ ID NO: 35012 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcaatacctcggcccttctcagttcgc

SEQ ID NO: 35013 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgccaatacctcggcccttctcagttcgc

SEQ ID NO: 35014 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcacaatacctcggcccttctcagttcgc

SEQ ID NO: 35015 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgccacaatacctcggcccttctcagttcgc

SEQ ID NO: 35016 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcccacaatacctcggcccttctcagttcgc

SEQ ID NO: 35017 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcgccacaatacctcggcccttctcagttcgc

SEQ ID NO: 35018 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgctgccacaatacctcggcccttctcagttcgc

SEQ ID NO: 35019 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcctgccacaatacctcggcccttctcagttcgc

SEQ ID NO: 35020 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcagttcgc

SEQ ID NO: 35021 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcagttcgc

SEQ ID NO: 35022 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcagttcgc

SEQ ID NO: 35023 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcagttcgc

SEQ ID NO: 35024 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcagttcgc

SEQ ID NO: 35025 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcagttcgc

SEQ ID NO: 35026 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcagttcgc

SEQ ID NO: 35027 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcagttcgc

SEQ ID NO: 35028 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcagttcgc

SEQ ID NO: 35029 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcagttcgc

SEQ ID NO: 35030 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcagttcgc

SEQ ID NO: 35031 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcagttcgc

SEQ ID NO: 35032 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgccggcccttctcagttcgc

SEQ ID NO: 35033 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcagttcgc

SEQ ID NO: 35034 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcagttcgc

SEQ ID NO: 35035 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcagttcgc

SEQ ID NO: 35036 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcagttcgc

SEQ ID NO: 35037 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcagttcgc

SEQ ID NO: 35038 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcagttcgc

SEQ ID NO: 35039 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcagttcgc

SEQ ID NO: 35040 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcagttcgc

SEQ ID NO: 35041 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcagttcgc

SEQ ID NO: 35042 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcagttcgc

SEQ ID NO: 35043 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgctcggcccttctcagttcgc

SEQ ID NO: 35044 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcagttcgc

SEQ ID NO: 35045 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcagttcgc

SEQ ID NO: 35046 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcagttcgc

SEQ ID NO: 35047 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcagttcgc

SEQ ID NO: 35048 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcagttcgc

SEQ ID NO: 35049 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcagttcgc

SEQ ID NO: 35050 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcagttcgc

SEQ ID NO: 35051 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcagttcgc

SEQ ID NO: 35052 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcagttcgc

SEQ ID NO: 35053 - DNA, 160 bp, synthetic construct
  source 1..160: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgc

SEQ ID NO: 35054 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcctcggcccttctcagttcgc

SEQ ID NO: 35055 - DNA, 161 bp, synthetic construct
  source 1..161: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgc

SEQ ID NO: 35056 - DNA, 162 bp, synthetic construct
  source 1..162: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgc

SEQ ID NO: 35057 - DNA, 163 bp, synthetic construct
  source 1..163: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgc

SEQ ID NO: 35058 - DNA, 164 bp, synthetic construct
  source 1..164: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgc

SEQ ID NO: 35059 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgccctcggcccttctcagttcgc

SEQ ID NO: 35060 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcacctcggcccttctcagttcgc

SEQ ID NO: 35061 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgctacctcggcccttctcagttcgc

SEQ ID NO: 35062 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcatacctcggcccttctcagttcgc

SEQ ID NO: 35063 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcaatacctcggcccttctcagttcgct

SEQ ID NO: 35064 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgccaatacctcggcccttctcagttcgct

SEQ ID NO: 35065 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcacaatacctcggcccttctcagttcgct

SEQ ID NO: 35066 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgccacaatacctcggcccttctcagttcgct

SEQ ID NO: 35067 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcccacaatacctcggcccttctcagttcgct

SEQ ID NO: 35068 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcgccacaatacctcggcccttctcagttcgct

SEQ ID NO: 35069 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgctgccacaatacctcggcccttctcagttcgct

SEQ ID NO: 35070 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcctgccacaatacctcggcccttctcagttcgct

SEQ ID NO: 35071 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcagttcgct

SEQ ID NO: 35072 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcagttcgct

SEQ ID NO: 35073 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcagttcgct

SEQ ID NO: 35074 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcagttcgct

SEQ ID NO: 35075 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcagttcgct

SEQ ID NO: 35076 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcagttcgct

SEQ ID NO: 35077 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcagttcgct

SEQ ID NO: 35078 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcagttcgct

SEQ ID NO: 35079 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcagttcgct

SEQ ID NO: 35080 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcagttcgct

SEQ ID NO: 35081 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcagttcgct

SEQ ID NO: 35082 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcagttcgct

SEQ ID NO: 35083 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgccggcccttctcagttcgct

SEQ ID NO: 35084 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcagttcgct

SEQ ID NO: 35085 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcagttcgct

SEQ ID NO: 35086 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcagttcgct

SEQ ID NO: 35087 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcagttcgct

SEQ ID NO: 35088 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcagttcgct

SEQ ID NO: 35089 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcagttcgct

SEQ ID NO: 35090 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcagttcgct

SEQ ID NO: 35091 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcagttcgct

SEQ ID NO: 35092 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcagttcgct

SEQ ID NO: 35093 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcagttcgct

SEQ ID NO: 35094 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgctcggcccttctcagttcgct

SEQ ID NO: 35095 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcagttcgct

SEQ ID NO: 35096 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcagttcgct

SEQ ID NO: 35097 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcagttcgct

SEQ ID NO: 35098 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcagttcgct

SEQ ID NO: 35099 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcagttcgct

SEQ ID NO: 35100 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcagttcgct

SEQ ID NO: 35101 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcagttcgct

SEQ ID NO: 35102 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcagttcgct

SEQ ID NO: 35103 - DNA, 160 bp, synthetic construct
  source 1..160: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcagttcgct

SEQ ID NO: 35104 - DNA, 161 bp, synthetic construct
  source 1..161: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgct

SEQ ID NO: 35105 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcctcggcccttctcagttcgct

SEQ ID NO: 35106 - DNA, 162 bp, synthetic construct
  source 1..162: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgct

SEQ ID NO: 35107 - DNA, 163 bp, synthetic construct
  source 1..163: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgct

SEQ ID NO: 35108 - DNA, 164 bp, synthetic construct
  source 1..164: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgct

SEQ ID NO: 35109 - DNA, 165 bp, synthetic construct
  source 1..165: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgct

SEQ ID NO: 35110 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgccctcggcccttctcagttcgct

SEQ ID NO: 35111 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcacctcggcccttctcagttcgct

SEQ ID NO: 35112 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctacctcggcccttctcagttcgct

SEQ ID NO: 35113 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcatacctcggcccttctcagttcgct

SEQ ID NO: 35114 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcaatacctcggcccttctcagttcgcta

SEQ ID NO: 35115 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgccaatacctcggcccttctcagttcgcta

SEQ ID NO: 35116 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcacaatacctcggcccttctcagttcgcta

SEQ ID NO: 35117 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgccacaatacctcggcccttctcagttcgcta

SEQ ID NO: 35118 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcccacaatacctcggcccttctcagttcgcta

SEQ ID NO: 35119 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcgccacaatacctcggcccttctcagttcgcta

SEQ ID NO: 35120 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgctgccacaatacctcggcccttctcagttcgcta

SEQ ID NO: 35121 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcctgccacaatacctcggcccttctcagttcgcta

SEQ ID NO: 35122 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcgctgccacaatacctcggcccttctcagttcgcta

SEQ ID NO: 35123 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgctgctgccacaatacctcggcccttctcagttcgcta

SEQ ID NO: 35124 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcttgctgccacaatacctcggcccttctcagttcgcta

SEQ ID NO: 35125 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgctttgctgccacaatacctcggcccttctcagttcgcta

SEQ ID NO: 35126 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttctcagttcgcta

SEQ ID NO: 35127 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttctcagttcgcta

SEQ ID NO: 35128 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttctcagttcgcta

SEQ ID NO: 35129 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttctcagttcgcta

SEQ ID NO: 35130 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttctcagttcgcta

SEQ ID NO: 35131 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttctcagttcgcta

SEQ ID NO: 35132 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttctcagttcgcta

SEQ ID NO: 35133 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttctcagttcgcta

SEQ ID NO: 35134 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgccggcccttctcagttcgcta

SEQ ID NO: 35135 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttctcagttcgcta

SEQ ID NO: 35136 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttctcagttcgcta

SEQ ID NO: 35137 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttctcagttcgcta

SEQ ID NO: 35138 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttctcagttcgcta

SEQ ID NO: 35139 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttctcagttcgcta

SEQ ID NO: 35140 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttctcagttcgcta

SEQ ID NO: 35141 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttctcagttcgcta

SEQ ID NO: 35142 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttctcagttcgcta

SEQ ID NO: 35143 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttctcagttcgcta

SEQ ID NO: 35144 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttctcagttcgcta

SEQ ID NO: 35145 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgctcggcccttctcagttcgcta

SEQ ID NO: 35146 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttctcagttcgcta

SEQ ID NO: 35147 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttctcagttcgcta

SEQ ID NO: 35148 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttctcagttcgcta

SEQ ID NO: 35149 - DNA, 156 bp, synthetic construct
  source 1..156: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttctcagttcgcta

SEQ ID NO: 35150 - DNA, 157 bp, synthetic construct
  source 1..157: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttctcagttcgcta

SEQ ID NO: 35151 - DNA, 158 bp, synthetic construct
  source 1..158: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttctcagttcgcta

SEQ ID NO: 35152 - DNA, 159 bp, synthetic construct
  source 1..159: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttctcagttcgcta

SEQ ID NO: 35153 - DNA, 160 bp, synthetic construct
  source 1..160: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttctcagttcgcta

SEQ ID NO: 35154 - DNA, 161 bp, synthetic construct
  source 1..161: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttctcagttcgcta

SEQ ID NO: 35155 - DNA, 162 bp, synthetic construct
  source 1..162: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttctcagttcgcta

SEQ ID NO: 35156 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcctcggcccttctcagttcgcta

SEQ ID NO: 35157 - DNA, 163 bp, synthetic construct
  source 1..163: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttctcagttcgcta

SEQ ID NO: 35158 - DNA, 164 bp, synthetic construct
  source 1..164: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttctcagttcgcta

SEQ ID NO: 35159 - DNA, 165 bp, synthetic construct
  source 1..165: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttctcagttcgcta

SEQ ID NO: 35160 - DNA, 166 bp, synthetic construct
  source 1..166: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttctcagttcgcta

SEQ ID NO: 35161 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgccctcggcccttctcagttcgcta

SEQ ID NO: 35162 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcacctcggcccttctcagttcgcta

SEQ ID NO: 35163 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctacctcggcccttctcagttcgcta

SEQ ID NO: 35164 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcatacctcggcccttctcagttcgcta

SEQ ID NO: 35165 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgcaatacctcggc

SEQ ID NO: 35166 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgccaatacctcggc

SEQ ID NO: 35167 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgcacaatacctcggc

SEQ ID NO: 35168 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgccacaatacctcggc

SEQ ID NO: 35169 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgcccacaatacctcggc

SEQ ID NO: 35170 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgcgccacaatacctcggc

SEQ ID NO: 35171 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgctgccacaatacctcggc

SEQ ID NO: 35172 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcctgccacaatacctcggc

SEQ ID NO: 35173 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcgctgccacaatacctcggc

SEQ ID NO: 35174 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgctgctgccacaatacctcggc

SEQ ID NO: 35175 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcttgctgccacaatacctcggc

SEQ ID NO: 35176 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgctttgctgccacaatacctcggc

SEQ ID NO: 35177 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcctttgctgccacaatacctcggc

SEQ ID NO: 35178 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcactttgctgccacaatacctcggc

SEQ ID NO: 35179 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcaactttgctgccacaatacctcggc

SEQ ID NO: 35180 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcgaactttgctgccacaatacctcggc

SEQ ID NO: 35181 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcggaactttgctgccacaatacctcggc

SEQ ID NO: 35182 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggc

SEQ ID NO: 35183 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggc

SEQ ID NO: 35184 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggc

SEQ ID NO: 35185 - DNA, 100 bp, synthetic construct
  source 1..100: mol_type = other DNA
tagcgaactgagaagggccagttttagagctagaaatagcaagttaaaataaggctagtccgttatcaacttgaaaaagtggcaccgagtcggtgccggc

SEQ ID NO: 35186 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggc

SEQ ID NO: 35187 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggc

SEQ ID NO: 35188 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggc

SEQ ID NO: 35189 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggc

SEQ ID NO: 35190 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggc

SEQ ID NO: 35191 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggc

SEQ ID NO: 35192 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggc

SEQ ID NO: 35193 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggc

SEQ ID NO: 35194 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggc

SEQ ID NO: 35195 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggc

SEQ ID NO: 35196 - DNA, 101 bp, synthetic construct
  source 1..101: mol_type = other DNA
tagcgaactgagaagggccagttttagagctagaaatagcaagttaaaataaggctagtccgttatcaacttgaaaaagtggcaccgagtcggtgctcggc

SEQ ID NO: 35197 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggc

SEQ ID NO: 35198 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggc

SEQ ID NO: 35199 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggc

SEQ ID NO: 35200 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggc

SEQ ID NO: 35201 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggc

SEQ ID NO: 35202 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggc

SEQ ID NO: 35203 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggc

SEQ ID NO: 35204 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggc

SEQ ID NO: 35205 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggc

SEQ ID NO: 35206 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggc

SEQ ID NO: 35207 - DNA, 102 bp, synthetic construct
  source 1..102: mol_type = other DNA
tagcgaactgagaagggccagttttagagctagaaatagcaagttaaaataaggctagtccgttatcaacttgaaaaagtggcaccgagtcggtgcctcggc

SEQ ID NO: 35208 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggc

SEQ ID NO: 35209 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggc

SEQ ID NO: 35210 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggc

SEQ ID NO: 35211 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggc

SEQ ID NO: 35212 - DNA, 103 bp, synthetic construct
  source 1..103: mol_type = other DNA
tagcgaactgagaagggccagttttagagctagaaatagcaagttaaaataaggctagtccgttatcaacttgaaaaagtggcaccgagtcggtgccctcggc

SEQ ID NO: 35213 - DNA, 104 bp, synthetic construct
  source 1..104: mol_type = other DNA
tagcgaactgagaagggccagttttagagctagaaatagcaagttaaaataaggctagtccgttatcaacttgaaaaagtggcaccgagtcggtgcacctcggc

SEQ ID NO: 35214 - DNA, 105 bp, synthetic construct
  source 1..105: mol_type = other DNA
tagcgaactgagaagggccagttttagagctagaaatagcaagttaaaataaggctagtccgttatcaacttgaaaaagtggcaccgagtcggtgctacctcggc

SEQ ID NO: 35215 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgcatacctcggc

SEQ ID NO: 35216 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgcaatacctcggcc

SEQ ID NO: 35217 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgccaatacctcggcc

SEQ ID NO: 35218 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgcacaatacctcggcc

SEQ ID NO: 35219 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgccacaatacctcggcc

SEQ ID NO: 35220 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgcccacaatacctcggcc

SEQ ID NO: 35221 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcgccacaatacctcggcc

SEQ ID NO: 35222 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgctgccacaatacctcggcc

SEQ ID NO: 35223 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcctgccacaatacctcggcc

SEQ ID NO: 35224 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcgctgccacaatacctcggcc

SEQ ID NO: 35225 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgctgctgccacaatacctcggcc

SEQ ID NO: 35226 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcttgctgccacaatacctcggcc

SEQ ID NO: 35227 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgctttgctgccacaatacctcggcc

SEQ ID NO: 35228 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcctttgctgccacaatacctcggcc

SEQ ID NO: 35229 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcactttgctgccacaatacctcggcc

SEQ ID NO: 35230 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcaactttgctgccacaatacctcggcc

SEQ ID NO: 35231 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcc

SEQ ID NO: 35232 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcc

SEQ ID NO: 35233 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcc

SEQ ID NO: 35234 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcc

SEQ ID NO: 35235 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcc

SEQ ID NO: 35236 - DNA, 101 bp, synthetic construct
  source 1..101: mol_type = other DNA
tagcgaactgagaagggccagttttagagctagaaatagcaagttaaaataaggctagtccgttatcaacttgaaaaagtggcaccgagtcggtgccggcc

SEQ ID NO: 35237 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcc

SEQ ID NO: 35238 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcc

SEQ ID NO: 35239 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcc

SEQ ID NO: 35240 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcc

SEQ ID NO: 35241 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcc

SEQ ID NO: 35242 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcc

SEQ ID NO: 35243 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcc

SEQ ID NO: 35244 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcc

SEQ ID NO: 35245 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcc

SEQ ID NO: 35246 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcc

SEQ ID NO: 35247 - DNA, 102 bp, synthetic construct
  source 1..102: mol_type = other DNA
tagcgaactgagaagggccagttttagagctagaaatagcaagttaaaataaggctagtccgttatcaacttgaaaaagtggcaccgagtcggtgctcggcc

SEQ ID NO: 35248 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcc

SEQ ID NO: 35249 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcc

SEQ ID NO: 35250 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcc

SEQ ID NO: 35251 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcc

SEQ ID NO: 35252 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcc

SEQ ID NO: 35253 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcc

SEQ ID NO: 35254 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcc

SEQ ID NO: 35255 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcc

SEQ ID NO: 35256 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcc

SEQ ID NO: 35257 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcc

SEQ ID NO: 35258 - DNA, 103 bp, synthetic construct
  source 1..103: mol_type = other DNA
tagcgaactgagaagggccagttttagagctagaaatagcaagttaaaataaggctagtccgttatcaacttgaaaaagtggcaccgagtcggtgcctcggcc

SEQ ID NO: 35259 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcc

SEQ ID NO: 35260 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcc

SEQ ID NO: 35261 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcc

SEQ ID NO: 35262 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcc

SEQ ID NO: 35263 - DNA, 104 bp, synthetic construct
  source 1..104: mol_type = other DNA
tagcgaactgagaagggccagttttagagctagaaatagcaagttaaaataaggctagtccgttatcaacttgaaaaagtggcaccgagtcggtgccctcggcc

SEQ ID NO: 35264 - DNA, 105 bp, synthetic construct
  source 1..105: mol_type = other DNA
tagcgaactgagaagggccagttttagagctagaaatagcaagttaaaataaggctagtccgttatcaacttgaaaaagtggcaccgagtcggtgcacctcggcc

SEQ ID NO: 35265 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgctacctcggcc

SEQ ID NO: 35266 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgcatacctcggcc

SEQ ID NO: 35267 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgcaatacctcggccc

SEQ ID NO: 35268 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgccaatacctcggccc

SEQ ID NO: 35269 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgcacaatacctcggccc

SEQ ID NO: 35270 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgccacaatacctcggccc

SEQ ID NO: 35271 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcccacaatacctcggccc

SEQ ID NO: 35272 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcgccacaatacctcggccc

SEQ ID NO: 35273 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgctgccacaatacctcggccc

SEQ ID NO: 35274 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcctgccacaatacctcggccc

SEQ ID NO: 35275 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcgctgccacaatacctcggccc

SEQ ID NO: 35276 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgctgctgccacaatacctcggccc

SEQ ID NO: 35277 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcttgctgccacaatacctcggccc

SEQ ID NO: 35278 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctttgctgccacaatacctcggccc

SEQ ID NO: 35279 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcctttgctgccacaatacctcggccc

SEQ ID NO: 35280 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcactttgctgccacaatacctcggccc

SEQ ID NO: 35281 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcaactttgctgccacaatacctcggccc

SEQ ID NO: 35282 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcgaactttgctgccacaatacctcggccc

SEQ ID NO: 35283 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcggaactttgctgccacaatacctcggccc

SEQ ID NO: 35284 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggccc

SEQ ID NO: 35285 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggccc

SEQ ID NO: 35286 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggccc

SEQ ID NO: 35287 - DNA, 102 bp, synthetic construct
  source 1..102: mol_type = other DNA
tagcgaactgagaagggccagttttagagctagaaatagcaagttaaaataaggctagtccgttatcaacttgaaaaagtggcaccgagtcggtgccggccc

SEQ ID NO: 35288 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggccc

SEQ ID NO: 35289 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggccc

SEQ ID NO: 35290 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggccc

SEQ ID NO: 35291 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggccc

SEQ ID NO: 35292 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggccc

SEQ ID NO: 35293 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggccc

SEQ ID NO: 35294 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggccc

SEQ ID NO: 35295 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggccc

SEQ ID NO: 35296 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggccc

SEQ ID NO: 35297 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggccc

SEQ ID NO: 35298 - DNA, 103 bp, synthetic construct
  source 1..103: mol_type = other DNA
tagcgaactgagaagggccagttttagagctagaaatagcaagttaaaataaggctagtccgttatcaacttgaaaaagtggcaccgagtcggtgctcggccc

SEQ ID NO: 35299 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggccc

SEQ ID NO: 35300 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggccc

SEQ ID NO: 35301 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggccc

SEQ ID NO: 35302 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggccc

SEQ ID NO: 35303 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggccc

SEQ ID NO: 35304 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggccc

SEQ ID NO: 35305 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggccc

SEQ ID NO: 35306 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggccc

SEQ ID NO: 35307 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggccc

SEQ ID NO: 35308 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggccc

SEQ ID NO: 35309 - DNA, 104 bp, synthetic construct
  source 1..104: mol_type = other DNA
tagcgaactgagaagggccagttttagagctagaaatagcaagttaaaataaggctagtccgttatcaacttgaaaaagtggcaccgagtcggtgcctcggccc

SEQ ID NO: 35310 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggccc

SEQ ID NO: 35311 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggccc

SEQ ID NO: 35312 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggccc

SEQ ID NO: 35313 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggccc

SEQ ID NO: 35314 - DNA, 105 bp, synthetic construct
  source 1..105: mol_type = other DNA
tagcgaactgagaagggccagttttagagctagaaatagcaagttaaaataaggctagtccgttatcaacttgaaaaagtggcaccgagtcggtgccctcggccc

SEQ ID NO: 35315 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgcacctcggccc

SEQ ID NO: 35316 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgctacctcggccc

SEQ ID NO: 35317 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgcatacctcggccc

SEQ ID NO: 35318 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgcaatacctcggccct

SEQ ID NO: 35319 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgccaatacctcggccct

SEQ ID NO: 35320 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgcacaatacctcggccct

SEQ ID NO: 35321 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgccacaatacctcggccct

SEQ ID NO: 35322 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcccacaatacctcggccct

SEQ ID NO: 35323 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcgccacaatacctcggccct

SEQ ID NO: 35324 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgctgccacaatacctcggccct

SEQ ID NO: 35325 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcctgccacaatacctcggccct

SEQ ID NO: 35326 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcgctgccacaatacctcggccct

SEQ ID NO: 35327 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgctgctgccacaatacctcggccct

SEQ ID NO: 35328 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcttgctgccacaatacctcggccct

SEQ ID NO: 35329 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctttgctgccacaatacctcggccct

SEQ ID NO: 35330 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcctttgctgccacaatacctcggccct

SEQ ID NO: 35331 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcactttgctgccacaatacctcggccct

SEQ ID NO: 35332 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcaactttgctgccacaatacctcggccct

SEQ ID NO: 35333 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcgaactttgctgccacaatacctcggccct

SEQ ID NO: 35334 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcggaactttgctgccacaatacctcggccct

SEQ ID NO: 35335 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggccct

SEQ ID NO: 35336 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggccct

SEQ ID NO: 35337 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggccct

SEQ ID NO: 35338 - DNA, 103 bp, synthetic construct
  source 1..103: mol_type = other DNA
tagcgaactgagaagggccagttttagagctagaaatagcaagttaaaataaggctagtccgttatcaacttgaaaaagtggcaccgagtcggtgccggccct

SEQ ID NO: 35339 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggccct

SEQ ID NO: 35340 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggccct

SEQ ID NO: 35341 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggccct

SEQ ID NO: 35342 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggccct

SEQ ID NO: 35343 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggccct

SEQ ID NO: 35344 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggccct

SEQ ID NO: 35345 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggccct

SEQ ID NO: 35346 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggccct

SEQ ID NO: 35347 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggccct

SEQ ID NO: 35348 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggccct

SEQ ID NO: 35349 - DNA, 104 bp, synthetic construct
  source 1..104: mol_type = other DNA
tagcgaactgagaagggccagttttagagctagaaatagcaagttaaaataaggctagtccgttatcaacttgaaaaagtggcaccgagtcggtgctcggccct

SEQ ID NO: 35350 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggccct

SEQ ID NO: 35351 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggccct

SEQ ID NO: 35352 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggccct

SEQ ID NO: 35353 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggccct

SEQ ID NO: 35354 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggccct

SEQ ID NO: 35355 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggccct

SEQ ID NO: 35356 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggccct

SEQ ID NO: 35357 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggccct

SEQ ID NO: 35358 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggccct

SEQ ID NO: 35359 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggccct

SEQ ID NO: 35360 - DNA, 105 bp, synthetic construct
  source 1..105: mol_type = other DNA
tagcgaactgagaagggccagttttagagctagaaatagcaagttaaaataaggctagtccgttatcaacttgaaaaagtggcaccgagtcggtgcctcggccct

SEQ ID NO: 35361 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggccct

SEQ ID NO: 35362 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggccct

SEQ ID NO: 35363 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggccct

SEQ ID NO: 35364 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggccct

SEQ ID NO: 35365 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgccctcggccct

SEQ ID NO: 35366 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgcacctcggccct

SEQ ID NO: 35367 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgctacctcggccct

SEQ ID NO: 35368 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgcatacctcggccct

SEQ ID NO: 35369 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgcaatacctcggccctt

SEQ ID NO: 35370 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgccaatacctcggccctt

SEQ ID NO: 35371 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcacaatacctcggccctt

SEQ ID NO: 35372 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgccacaatacctcggccctt

SEQ ID NO: 35373 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcccacaatacctcggccctt

SEQ ID NO: 35374 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcgccacaatacctcggccctt

SEQ ID NO: 35375 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgctgccacaatacctcggccctt

SEQ ID NO: 35376 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcctgccacaatacctcggccctt

SEQ ID NO: 35377 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcgctgccacaatacctcggccctt

SEQ ID NO: 35378 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgctgctgccacaatacctcggccctt

SEQ ID NO: 35379 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcttgctgccacaatacctcggccctt

SEQ ID NO: 35380 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctttgctgccacaatacctcggccctt

SEQ ID NO: 35381 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcctttgctgccacaatacctcggccctt

SEQ ID NO: 35382 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcactttgctgccacaatacctcggccctt

SEQ ID NO: 35383 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcaactttgctgccacaatacctcggccctt

SEQ ID NO: 35384 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcgaactttgctgccacaatacctcggccctt

SEQ ID NO: 35385 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcggaactttgctgccacaatacctcggccctt

SEQ ID NO: 35386 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggccctt

SEQ ID NO: 35387 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggccctt

SEQ ID NO: 35388 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggccctt

SEQ ID NO: 35389 - DNA, 104 bp, synthetic construct
  source 1..104: mol_type = other DNA
tagcgaactgagaagggccagttttagagctagaaatagcaagttaaaataaggctagtccgttatcaacttgaaaaagtggcaccgagtcggtgccggccctt

SEQ ID NO: 35390 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggccctt

SEQ ID NO: 35391 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggccctt

SEQ ID NO: 35392 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggccctt

SEQ ID NO: 35393 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggccctt

SEQ ID NO: 35394 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggccctt

SEQ ID NO: 35395 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggccctt

SEQ ID NO: 35396 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggccctt

SEQ ID NO: 35397 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggccctt

SEQ ID NO: 35398 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggccctt

SEQ ID NO: 35399 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggccctt

SEQ ID NO: 35400 - DNA, 105 bp, synthetic construct
  source 1..105: mol_type = other DNA
tagcgaactgagaagggccagttttagagctagaaatagcaagttaaaataaggctagtccgttatcaacttgaaaaagtggcaccgagtcggtgctcggccctt

SEQ ID NO: 35401 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggccctt

SEQ ID NO: 35402 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggccctt

SEQ ID NO: 35403 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggccctt

SEQ ID NO: 35404 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggccctt

SEQ ID NO: 35405 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggccctt

SEQ ID NO: 35406 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggccctt

SEQ ID NO: 35407 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggccctt

SEQ ID NO: 35408 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggccctt

SEQ ID NO: 35409 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggccctt

SEQ ID NO: 35410 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggccctt

SEQ ID NO: 35411 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgcctcggccctt

SEQ ID NO: 35412 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggccctt

SEQ ID NO: 35413 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggccctt

SEQ ID NO: 35414 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggccctt

SEQ ID NO: 35415 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggccctt

SEQ ID NO: 35416 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgccctcggccctt

SEQ ID NO: 35417 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgcacctcggccctt

SEQ ID NO: 35418 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgctacctcggccctt

SEQ ID NO: 35419 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgcatacctcggccctt

SEQ ID NO: 35420 - DNA, 112 bp, synthetic construct
  source 1..112: mol_type = other DNA
tagcgaactgagaagggccagttttagagctagaaatagcaagttaaaataaggctagtccgttatcaacttgaaaaagtggcaccgagtcggtgcaatacctcggcccttc

SEQ ID NO: 35421 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgccaatacctcggcccttc

SEQ ID NO: 35422 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgcacaatacctcggcccttc

SEQ ID NO: 35423 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgccacaatacctcggcccttc

SEQ ID NO: 35424 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgcccacaatacctcggcccttc

SEQ ID NO: 35425 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcgccacaatacctcggcccttc

SEQ ID NO: 35426 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgctgccacaatacctcggcccttc

SEQ ID NO: 35427 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgcctgccacaatacctcggcccttc

SEQ ID NO: 35428 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcgctgccacaatacctcggcccttc

SEQ ID NO: 35429 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgctgctgccacaatacctcggcccttc

SEQ ID NO: 35430 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgcttgctgccacaatacctcggcccttc

SEQ ID NO: 35431 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgctttgctgccacaatacctcggcccttc

SEQ ID NO: 35432 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttc

SEQ ID NO: 35433 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttc

SEQ ID NO: 35434 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttc

SEQ ID NO: 35435 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttc

SEQ ID NO: 35436 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcggaactttgctgccacaatacctcggcccttc

SEQ ID NO: 35437 - DNA, 129 bp, synthetic construct
  source 1..129: mol_type = other DNA
tagcgaactgagaagggccagttttagagctagaaatagcaagttaaaataaggctagtccgttatcaacttgaaaaagtggcaccgagtcggtgcaggaactttgctgccacaatacctcggcccttc

SEQ ID NO: 35438 - DNA, 130 bp, synthetic construct
  source 1..130: mol_type = other DNA
tagcgaactgagaagggccagttttagagctagaaatagcaagttaaaataaggctagtccgttatcaacttgaaaaagtggcaccgagtcggtgctaggaactttgctgccacaatacctcggcccttc

SEQ ID NO: 35439 - DNA, 131 bp, synthetic construct
  source 1..131: mol_type = other DNA
tagcgaactgagaagggccagttttagagctagaaatagcaagttaaaataaggctagtccgttatcaacttgaaaaagtggcaccgagtcggtgcttaggaactttgctgccacaatacctcggcccttc

SEQ ID NO: 35440 - DNA, 105 bp, synthetic construct
  source 1..105: mol_type = other DNA
tagcgaactgagaagggccagttttagagctagaaatagcaagttaaaataaggctagtccgttatcaacttgaaaaagtggcaccgagtcggtgccggcccttc

SEQ ID NO: 35441 - DNA, 132 bp, synthetic construct
  source 1..132: mol_type = other DNA
tagcgaactgagaagggccagttttagagctagaaatagcaagttaaaataaggctagtccgttatcaacttgaaaaagtggcaccgagtcggtgccttaggaactttgctgccacaatacctcggcccttc

SEQ ID NO: 35442 - DNA, 133 bp, synthetic construct
  source 1..133: mol_type = other DNA
tagcgaactgagaagggccagttttagagctagaaatagcaagttaaaataaggctagtccgttatcaacttgaaaaagtggcaccgagtcggtgctcttaggaactttgctgccacaatacctcggcccttc

SEQ ID NO: 35443 - DNA, 134 bp, synthetic construct
  source 1..134: mol_type = other DNA
tagcgaactgagaagggccagttttagagctagaaatagcaagttaaaataaggctagtccgttatcaacttgaaaaagtggcaccgagtcggtgcgtcttaggaactttgctgccacaatacctcggcccttc

SEQ ID NO: 35444 - DNA, 135 bp, synthetic construct
  source 1..135: mol_type = other DNA
tagcgaactgagaagggccagttttagagctagaaatagcaagttaaaataaggctagtccgttatcaacttgaaaaagtggcaccgagtcggtgcggtcttaggaactttgctgccacaatacctcggcccttc

SEQ ID NO: 35445 - DNA, 136 bp, synthetic construct
  source 1..136: mol_type = other DNA
tagcgaactgagaagggccagttttagagctagaaatagcaagttaaaataaggctagtccgttatcaacttgaaaaagtggcaccgagtcggtgctggtcttaggaactttgctgccacaatacctcggcccttc

SEQ ID NO: 35446 - DNA, 137 bp, synthetic construct
  source 1..137: mol_type = other DNA
tagcgaactgagaagggccagttttagagctagaaatagcaagttaaaataaggctagtccgttatcaacttgaaaaagtggcaccgagtcggtgcttggtcttaggaactttgctgccacaatacctcggcccttc

SEQ ID NO: 35447 - DNA, 138 bp, synthetic construct
  source 1..138: mol_type = other DNA
tagcgaactgagaagggccagttttagagctagaaatagcaagttaaaataaggctagtccgttatcaacttgaaaaagtggcaccgagtcggtgctttggtcttaggaactttgctgccacaatacctcggcccttc

SEQ ID NO: 35448 - DNA, 139 bp, synthetic construct
  source 1..139: mol_type = other DNA
tagcgaactgagaagggccagttttagagctagaaatagcaagttaaaataaggctagtccgttatcaacttgaaaaagtggcaccgagtcggtgcttttggtcttaggaactttgctgccacaatacctcggcccttc

SEQ ID NO: 35449 - DNA, 140 bp, synthetic construct
  source 1..140: mol_type = other DNA
tagcgaactgagaagggccagttttagagctagaaatagcaagttaaaataaggctagtccgttatcaacttgaaaaagtggcaccgagtcggtgcgttttggtcttaggaactttgctgccacaatacctcggcccttc

SEQ ID NO: 35450 - DNA, 141 bp, synthetic construct
  source 1..141: mol_type = other DNA
tagcgaactgagaagggccagttttagagctagaaatagcaagttaaaataaggctagtccgttatcaacttgaaaaagtggcaccgagtcggtgcggttttggtcttaggaactttgctgccacaatacctcggcccttc

SEQ ID NO: 35451 - DNA, 106 bp, synthetic construct
  source 1..106: mol_type = other DNA
tagcgaactgagaagggccagttttagagctagaaatagcaagttaaaataaggctagtccgttatcaacttgaaaaagtggcaccgagtcggtgctcggcccttc

SEQ ID NO: 35452 - DNA, 142 bp, synthetic construct
  source 1..142: mol_type = other DNA
tagcgaactgagaagggccagttttagagctagaaatagcaagttaaaataaggctagtccgttatcaacttgaaaaagtggcaccgagtcggtgctggttttggtcttaggaactttgctgccacaatacctcggcccttc

SEQ ID NO: 35453 - DNA, 143 bp, synthetic construct
  source 1..143: mol_type = other DNA
tagcgaactgagaagggccagttttagagctagaaatagcaagttaaaataaggctagtccgttatcaacttgaaaaagtggcaccgagtcggtgcgtggttttggtcttaggaactttgctgccacaatacctcggcccttc

SEQ ID NO: 35454 - DNA, 144 bp, synthetic construct
  source 1..144: mol_type = other DNA
tagcgaactgagaagggccagttttagagctagaaatagcaagttaaaataaggctagtccgttatcaacttgaaaaagtggcaccgagtcggtgctgtggttttggtcttaggaactttgctgccacaatacctcggcccttc

SEQ ID NO: 35455 - DNA, 145 bp, synthetic construct
  source 1..145: mol_type = other DNA
tagcgaactgagaagggccagttttagagctagaaatagcaagttaaaataaggctagtccgttatcaacttgaaaaagtggcaccgagtcggtgcctgtggttttggtcttaggaactttgctgccacaatacctcggcccttc

SEQ ID NO: 35456 - DNA, 146 bp, synthetic construct
  source 1..146: mol_type = other DNA
tagcgaactgagaagggccagttttagagctagaaatagcaagttaaaataaggctagtccgttatcaacttgaaaaagtggcaccgagtcggtgccctgtggttttggtcttaggaactttgctgccacaatacctcggcccttc

SEQ ID NO: 35457 - DNA, 147 bp, synthetic construct
  source 1..147: mol_type = other DNA
tagcgaactgagaagggccagttttagagctagaaatagcaagttaaaataaggctagtccgttatcaacttgaaaaagtggcaccgagtcggtgcgcctgtggttttggtcttaggaactttgctgccacaatacctcggcccttc

SEQ ID NO: 35458 - DNA, 148 bp, synthetic construct
  source 1..148: mol_type = other DNA
tagcgaactgagaagggccagttttagagctagaaatagcaagttaaaataaggctagtccgttatcaacttgaaaaagtggcaccgagtcggtgcagcctgtggttttggtcttaggaactttgctgccacaatacctcggcccttc

SEQ ID NO: 35459 - DNA, 149 bp, synthetic construct
  source 1..149: mol_type = other DNA
tagcgaactgagaagggccagttttagagctagaaatagcaagttaaaataaggctagtccgttatcaacttgaaaaagtggcaccgagtcggtgcaagcctgtggttttggtcttaggaactttgctgccacaatacctcggcccttc

SEQ ID NO: 35460 - DNA, 150 bp, synthetic construct
  source 1..150: mol_type = other DNA
tagcgaactgagaagggccagttttagagctagaaatagcaagttaaaataaggctagtccgttatcaacttgaaaaagtggcaccgagtcggtgccaagcctgtggttttggtcttaggaactttgctgccacaatacctcggcccttc

SEQ ID NO: 35461 - DNA, 151 bp, synthetic construct
  source 1..151: mol_type = other DNA
tagcgaactgagaagggccagttttagagctagaaatagcaagttaaaataaggctagtccgttatcaacttgaaaaagtggcaccgagtcggtgctcaagcctgtggttttggtcttaggaactttgctgccacaatacctcggcccttc

SEQ ID NO: 35462 - DNA, 107 bp, synthetic construct
  source 1..107: mol_type = other DNA
tagcgaactgagaagggccagttttagagctagaaatagcaagttaaaataaggctagtccgttatcaacttgaaaaagtggcaccgagtcggtgcctcggcccttc

SEQ ID NO: 35463 - DNA, 152 bp, synthetic construct
  source 1..152: mol_type = other DNA
tagcgaactgagaagggccagttttagagctagaaatagcaagttaaaataaggctagtccgttatcaacttgaaaaagtggcaccgagtcggtgcctcaagcctgtggttttggtcttaggaactttgctgccacaatacctcggcccttc

SEQ ID NO: 35464 - DNA, 153 bp, synthetic construct
  source 1..153: mol_type = other DNA
tagcgaactgagaagggccagttttagagctagaaatagcaagttaaaataaggctagtccgttatcaacttgaaaaagtggcaccgagtcggtgcactcaagcctgtggttttggtcttaggaactttgctgccacaatacctcggcccttc

SEQ ID NO: 35465 - DNA, 154 bp, synthetic construct
  source 1..154: mol_type = other DNA
tagcgaactgagaagggccagttttagagctagaaatagcaagttaaaataaggctagtccgttatcaacttgaaaaagtggcaccgagtcggtgccactcaagcctgtggttttggtcttaggaactttgctgccacaatacctcggcccttc

SEQ ID NO: 35466 - DNA, 155 bp, synthetic construct
  source 1..155: mol_type = other DNA
tagcgaactgagaagggccagttttagagctagaaatagcaagttaaaataaggctagtccgttatcaacttgaaaaagtggcaccgagtcggtgctcactcaagcctgtggttttggtcttaggaactttgctgccacaatacctcggcccttc

SEQ ID NO: 35467 - DNA, 108 bp, synthetic construct
  source 1..108: mol_type = other DNA
tagcgaactgagaagggccagttttagagctagaaatagcaagttaaaataaggctagtccgttatcaacttgaaaaagtggcaccgagtcggtgccctcggcccttc

SEQ ID NO: 35468 - DNA, 109 bp, synthetic construct
  source 1..109: mol_type = other DNA
tagcgaactgagaagggccagttttagagctagaaatagcaagttaaaataaggctagtccgttatcaacttgaaaaagtggcaccgagtcggtgcacctcggcccttc

SEQ ID NO: 35469 - DNA, 110 bp, synthetic construct
  source 1..110: mol_type = other DNA
tagcgaactgagaagggccagttttagagctagaaatagcaagttaaaataaggctagtccgttatcaacttgaaaaagtggcaccgagtcggtgctacctcggcccttc

SEQ ID NO: 35470 - DNA, 111 bp, synthetic construct
  source 1..111: mol_type = other DNA
tagcgaactgagaagggccagttttagagctagaaatagcaagttaaaataaggctagtccgttatcaacttgaaaaagtggcaccgagtcggtgcatacctcggcccttc

SEQ ID NO: 35471 - DNA, 113 bp, synthetic construct
  source 1..113: mol_type = other DNA
tagcgaactgagaagggccagttttagagctagaaatagcaagttaaaataaggctagtccgttatcaacttgaaaaagtggcaccgagtcggtgcaatacctcggcccttct

SEQ ID NO: 35472 - DNA, 114 bp, synthetic construct
  source 1..114: mol_type = other DNA
tagcgaactgagaagggccagttttagagctagaaatagcaagttaaaataaggctagtccgttatcaacttgaaaaagtggcaccgagtcggtgccaatacctcggcccttct

SEQ ID NO: 35473 - DNA, 115 bp, synthetic construct
  source 1..115: mol_type = other DNA
tagcgaactgagaagggccagttttagagctagaaatagcaagttaaaataaggctagtccgttatcaacttgaaaaagtggcaccgagtcggtgcacaatacctcggcccttct

SEQ ID NO: 35474 - DNA, 116 bp, synthetic construct
  source 1..116: mol_type = other DNA
tagcgaactgagaagggccagttttagagctagaaatagcaagttaaaataaggctagtccgttatcaacttgaaaaagtggcaccgagtcggtgccacaatacctcggcccttct

SEQ ID NO: 35475 - DNA, 117 bp, synthetic construct
  source 1..117: mol_type = other DNA
tagcgaactgagaagggccagttttagagctagaaatagcaagttaaaataaggctagtccgttatcaacttgaaaaagtggcaccgagtcggtgcccacaatacctcggcccttct

SEQ ID NO: 35476 - DNA, 118 bp, synthetic construct
  source 1..118: mol_type = other DNA
tagcgaactgagaagggccagttttagagctagaaatagcaagttaaaataaggctagtccgttatcaacttgaaaaagtggcaccgagtcggtgcgccacaatacctcggcccttct

SEQ ID NO: 35477 - DNA, 119 bp, synthetic construct
  source 1..119: mol_type = other DNA
tagcgaactgagaagggccagttttagagctagaaatagcaagttaaaataaggctagtccgttatcaacttgaaaaagtggcaccgagtcggtgctgccacaatacctcggcccttct

SEQ ID NO: 35478 - DNA, 120 bp, synthetic construct
  source 1..120: mol_type = other DNA
tagcgaactgagaagggccagttttagagctagaaatagcaagttaaaataaggctagtccgttatcaacttgaaaaagtggcaccgagtcggtgcctgccacaatacctcggcccttct

SEQ ID NO: 35479 - DNA, 121 bp, synthetic construct
  source 1..121: mol_type = other DNA
tagcgaactgagaagggccagttttagagctagaaatagcaagttaaaataaggctagtccgttatcaacttgaaaaagtggcaccgagtcggtgcgctgccacaatacctcggcccttct

SEQ ID NO: 35480 - DNA, 122 bp, synthetic construct
  source 1..122: mol_type = other DNA
tagcgaactgagaagggccagttttagagctagaaatagcaagttaaaataaggctagtccgttatcaacttgaaaaagtggcaccgagtcggtgctgctgccacaatacctcggcccttct

SEQ ID NO: 35481 - DNA, 123 bp, synthetic construct
  source 1..123: mol_type = other DNA
tagcgaactgagaagggccagttttagagctagaaatagcaagttaaaataaggctagtccgttatcaacttgaaaaagtggcaccgagtcggtgcttgctgccacaatacctcggcccttct

SEQ ID NO: 35482 - DNA, 124 bp, synthetic construct
  source 1..124: mol_type = other DNA
tagcgaactgagaagggccagttttagagctagaaatagcaagttaaaataaggctagtccgttatcaacttgaaaaagtggcaccgagtcggtgctttgctgccacaatacctcggcccttct

SEQ ID NO: 35483 - DNA, 125 bp, synthetic construct
  source 1..125: mol_type = other DNA
tagcgaactgagaagggccagttttagagctagaaatagcaagttaaaataaggctagtccgttatcaacttgaaaaagtggcaccgagtcggtgcctttgctgccacaatacctcggcccttct

SEQ ID NO: 35484 - DNA, 126 bp, synthetic construct
  source 1..126: mol_type = other DNA
tagcgaactgagaagggccagttttagagctagaaatagcaagttaaaataaggctagtccgttatcaacttgaaaaagtggcaccgagtcggtgcactttgctgccacaatacctcggcccttct

SEQ ID NO: 35485 - DNA, 127 bp, synthetic construct
  source 1..127: mol_type = other DNA
tagcgaactgagaagggccagttttagagctagaaatagcaagttaaaataaggctagtccgttatcaacttgaaaaagtggcaccgagtcggtgcaactttgctgccacaatacctcggcccttct

SEQ ID NO: 35486 - DNA, 128 bp, synthetic construct
  source 1..128: mol_type = other DNA
tagcgaactgagaagggccagttttagagctagaaatagcaagttaaaataaggctagtccgttatcaacttgaaaaagtggcaccgagtcggtgcgaactttgctgccacaatacctcggcccttct
